United States Patent
Anderson

(10) Patent No.: US 12,371,698 B2
(45) Date of Patent: Jul. 29, 2025

(54) TARGETED NUCLEAR RNA CLEAVAGE AND POLYADENYLATION WITH CRISPR-CAS

(71) Applicant: University of Rochester, Rochester, NY (US)

(72) Inventor: Douglas Matthew Anderson, Pittsford, NY (US)

(73) Assignee: University of Rochester, Rochester, NY (US)

(*) Notice: Subject to any disclaimer, the term of this patent is extended or adjusted under 35 U.S.C. 154(b) by 1042 days.

(21) Appl. No.: 17/422,885

(22) PCT Filed: Jan. 14, 2020

(86) PCT No.: PCT/US2020/013577
§ 371 (c)(1),
(2) Date: Jul. 14, 2021

(87) PCT Pub. No.: WO2020/150287
PCT Pub. Date: Jul. 23, 2020

(65) Prior Publication Data
US 2022/0090088 A1    Mar. 24, 2022

Related U.S. Application Data

(60) Provisional application No. 62/877,415, filed on Jul. 23, 2019, provisional application No. 62/791,971, filed on Jan. 14, 2019.

(51) Int. Cl.
| C12N 15/63 | (2006.01) |
| C12N 9/22 | (2006.01) |
| C12N 15/113 | (2010.01) |
| C12N 15/62 | (2006.01) |

(52) U.S. Cl.
CPC .............. *C12N 15/63* (2013.01); *C12N 9/22* (2013.01); *C12N 15/113* (2013.01); *C12N 15/62* (2013.01); *C07K 2319/60* (2013.01); *C07K 2319/85* (2013.01); *C12N 2310/14* (2013.01); *C12N 2310/20* (2017.05)

(58) Field of Classification Search
None
See application file for complete search history.

(56) References Cited

U.S. PATENT DOCUMENTS

| 11,788,083 B2* | 10/2023 | Zhang | .................. C12N 15/111 435/463 |
| 2016/0355796 A1 | 12/2016 | Davidson | |
| 2019/0002875 A1 | 1/2019 | Cheng | |
| 2019/0002889 A1* | 1/2019 | Cheng | .................. C12N 9/22 |

FOREIGN PATENT DOCUMENTS

| CN | 110548134 | 12/2019 |
| WO | 2016196655 | 12/2016 |
| WO | 2017091630 | 6/2017 |
| WO | 2017219027 | 12/2017 |
| WO | 2018064352 | 4/2018 |
| WO | 2018064371 | 4/2018 |
| WO | 2018165541 | 9/2018 |
| WO | 2019010422 | 1/2019 |
| WO | 2019046540 | 3/2019 |
| WO | 2019094969 | 5/2019 |
| WO | 2019204210 | 10/2019 |
| WO | 2019236982 | 12/2019 |
| WO | 2019236998 | 12/2019 |
| WO | 2020014261 | 1/2020 |
| WO | 2020086627 | 4/2020 |
| WO | 2020150287 | 7/2020 |
| WO | 2021016453 | 1/2021 |

OTHER PUBLICATIONS

Chaikind et al. A programmable Cas9-serine recombinase fusion protein that operates on DNA sequences in mammalian cells. Nucleic Acids Research 2016, 44;20:9758-9770. (Year: 2016).*
"RNA editing with CRISPR-Cas 13, David B T Cox et al., Science" vol. 358, No. 6366, pp. 1019-1027, Oct. 25, 2017.
A Safety and Tolerability Study of Multiple Doses of ISIS-DMPKRx in Adults With Myotonic Dystrophy Type 1; clinicaltrials.gov identifier: NCT02312011; Dec. 6, 2022.
Abudayyeh, O. O. et al. C2c2 is a single-component programmable RNA-guided RNA-targeting CRISPR effector. Science 353, aaf5573, doi:10.1126/science.aaf5573 (2016).
Abudayyeh, O. O. et al. RNA targeting with CRISPR-Cas13. Nature 550, 280-284, doi:10.1038/nature24049 (2017).
Anderson, K. M. et al. Transcription of the non-coding RNA upperhand controls Hand2 expression and heart development. Nature 539, 433-436, doi:10.1038/nature20128 (2016).
Anderson, Kelly M., et al. "Targeted cleavage and polyadenylation of RNA by CRISPR-Cas13." BioRxiv (2019): 531111.
Batra, Ranjan, et al. "Elimination of toxic microsatellite repeat expansion RNA by RNA-targeting Cas9." Cell 170.5 (2017): 899-912.
Batra, Ranjan, et al. "Loss of MBNL leads to disruption of developmentally regulated alternative polyadenylation in RNA-mediated disease." Molecular cell 56.2 (2014): 311-322.
Brook, J. David, et al. "Molecular basis of myotonic dystrophy: expansion of a trinucleotide (CTG) repeat at the 3' end of a transcript encoding a protein kinase family member." Cell 68.4 (1992): 799-808.

(Continued)

*Primary Examiner* — Christopher M Babic
*Assistant Examiner* — Jennifer S Spence
(74) *Attorney, Agent, or Firm* — Riverside Law LLP

(57) ABSTRACT

The present invention provides proteins, nucleic acids, systems and methods for visualizing or modulating RNA.

10 Claims, 53 Drawing Sheets
(49 of 53 Drawing Sheet(s) Filed in Color)
Specification includes a Sequence Listing.

(56) References Cited

OTHER PUBLICATIONS

Brown, M. S. & Goldstein, J. L. The SREBP pathway: regulation of cholesterol metabolism by proteolysis of a membrane-bound transcription factor. Cell 89, 331-340 (1997).
Brown, M. S., Ye, J., Rawson, R. B. & Goldstein, J. L. Regulated intramembrane proteolysis: a control mechanism conserved from bacteria to humans. Cell 100, 391-398 (2000).
Brumbaugh, J. et al. Nudt21 Controls Cell Fate by Connecting Alternative Polyadenylation to Chromatin Signaling. Cell 172, 106-120 e121, doi:10.1016/j.cell.2017.11.023 (2018).
C. B. Gurumurthy et al., Reproducibility of CRISPR-Cas9 methods for generation of conditional mouse alleles: a multi-center evaluation. Genome Biol 20, 171 (2019).
Carmody, S. R. & Wente, S. R. mRNA nuclear export at a glance. J Cell Sci 122, 1933-1937, doi:10.1242/jcs. 041236 (2009).
Chan, S. L. et al. CPSF30 and Wdr33 directly bind to AAUAAA in mammalian mRNA 3' processing. Genes & development 28, 2370-2380, doi:10.1101/gad.250993.114 (2014).
Chang, J. W., Yeh, H. S. & Yong, J. Alternative Polyadenylation in Human Diseases. Endocrinol Metab (Seoul) 32, 413-421, doi:10.3803/EnM.2017.32.4.413 (2017).
Chunyu Liao et al., "Modular one-pot assembly of CRISPR arrays enables library generation and reveals factors influencing crRNA biogenesis", Nature Communications, (Jul. 3, 2019), vol. 10, No. 1, doi:10.1038/s41467-019-10747-3, XP055738525.
Colgan, D. F. & Manley, J. L. Mechanism and regulation of mRNA polyadenylation. Genes Dev 11, 2755-2766 (1997).
Cox, D. B. T. et al. RNA editing with CRISPR-Cas13. Science 358, 1019-1027, doi:10.1126/science.aaq0180 (2017).
Curinha, A., Oliveira Braz, S., Pereira-Castro, I., Cruz, A. & Moreira, A. Implications of polyadenylation in health and disease. Nucleus 5, 508-519, doi:10.4161/nucl.36360 (2014).
D. Reyon et al., FLASH assembly of TALENs for high-throughput genome editing. Nat Biotechnol 30, 460-465 (2012).
East-Seletsky, Alexandra, et al. "RNA targeting by functionally orthogonal type VI-A CRISPR-Cas enzymes." Molecular cell 66.3 (2017): 373-383.
Elkon, R., Ugalde, A. P. & Agami, R. Alternative cleavage and polyadenylation: extent, regulation and function. Nat Rev Genet 14, 496-506, doi:10.1038/nrg3482 (2013).
Engreitz, J. M. et al. Local regulation of gene expression by lncRNA promoters, transcription and splicing. Nature 539, 452-455, doi:10.1038/nature20149 (2016).
Feng, S. et al. Improved split fluorescent proteins for endogenous protein labeling. Nature communications 8, 370, doi:10.1038/s41467-017-00494-8 (2017).
Freije Catherine A et al, "Programmable Inhibition and Detection of RNA Viruses Using Cas13", Molecular Cell, Elsevier, Amsterdam , NL, vol. 76, No. 5, doi: 10.1016/J.MOLCEL.2019.09.013, ISSN 1097-2765, (Oct. 10, 2019), p. 826, (Oct. 10, 2019), XP085939974.
Fu, YH1, et al. "An unstable triplet repeat in a gene related to myotonic muscular dystrophy." Science 255.5049 (1992): 1256-1258.
Gao, Yuanzheng, et al. "Genome therapy of myotonic dystrophy type 1 iPS cells for development of autologous stem cell therapy." Molecular Therapy 24.8 (2016): 1378-1387.
Gao, Zongliang, Elena Herrera-Carrillo, and Ben Berkhout. "Delineation of the exact transcription termination signal for type 3 polymerase III." Molecular Therapy—Nucleic Acids 10 (2018): 36-44.
Guhaniyogi, J. & Brewer, G. Regulation of mRNA stability in mammalian cells. Gene 265, 11-23 (2001).
Harley, Helen G., et al. "Size of the unstable CTG repeat sequence in relation to phenotype and parental transmission in myotonic dystrophy." American journal of human genetics 52.6 (1993): 1164.
Higgs, D. R. et al. Alpha-thalassaemia caused by a polyadenylation signal mutation. Nature 306, 398-400 (1983).
Horton, J. D., Goldstein, J. L. & Brown, M. S. SREBPs: activators of the complete program of cholesterol and fatty acid synthesis in the liver. J Clin Invest 109, 1125-1131, doi:10.1172/JCI15593 (2002).
Jauvin, Dominic, et al. "Targeting DMPK with antisense oligonucleotide improves muscle strength in myotonic dystrophy type 1 mice." Molecular Therapy—Nucleic Acids 7 (2017): 465-474.
Jin, Y. & Bian, T. Nontemplated nucleotide addition prior to polyadenylation: a comparison of Arabidopsis cDNA and genomic sequences. RNA 10, 1695-1697, doi:10.1261/rna.7610404 (2004).
Joung, J. et al. Genome-scale activation screen identifies a lncRNA locus regulating a gene neighbourhood. Nature 548, 343-346, doi:10.1038/nature23451 (2017).
Kamiyama, D. et al. Versatile protein tagging in cells with split fluorescent protein. Nature communications 7, 11046, doi:10.1038/ncomms11046 (2016).
Kanadia, Rahul N., et al. "A muscleblind knockout model for myotonic dystrophy." science 302.5652 (2003): 1978-1980.
Kanadia, Rahul N., et al. "Reversal of RNA missplicing and myotonia after muscleblind overexpression in a mouse poly (CUG) model for myotonic dystrophy." Proceedings of the National Academy of Sciences 103.31 (2006): 11748-11753.
Kenna, M. A., Brachmann, C. B., Devine, S. E. & Boeke, J. D. Invading the yeast nucleus: a nuclear localization signal at the C terminus of Ty1 integrase is required for transposition in vivo. Mol Cell Biol 18, 1115-1124 (1998).
Kuyumcu-Martinez, N. Muge, and Thomas A. Cooper. "Misregulation of alternative splicing causes pathogenesis in myotonic dystrophy." Alternative Splicing and Disease (2006): 133-159.
L. Cong et al., Multiplex genome engineering using CRISPR/Cas systems. Science 339, 819-823 (2013).
Lee, Kuang-Yung, et al. "Compound loss of muscleblind-like function in myotonic dystrophy." EYadava et al., Hum Geet, 2019MBO molecular medicine 5.12 (2013): 1887-1900.
Levitt, N., Briggs, D., Gil, A. & Proudfoot, N. J. Definition of an efficient synthetic poly(A) site. Genes & development 3, 1019-1025 (1989).
Li Lin et al., "Engineering the Direct Repeat Sequence of crRNA for Optimization of FnCpf1-Mediated Genome Editing in Human Cells", Molecular Therapy, Nov. 2018, vol. 26, No. 11, p. 2650-2657, DOI: 10.1016/j.ymthe.2018.08.021.
Mahadevan, Mani, et al. "Myotonic dystrophy mutation: an unstable CTG repeat in the 3' untranslated region of the gene." Science 255.5049 (1992): 1253-1255.
Mandel, C. R., Bai, Y. & Tong, L. Protein factors in pre-mRNA 3'-end processing. Cell Mol Life Sci 65, 1099-1122, doi:10.1007/s00018-007-7474-3 (2008).
Mankodi, Ami, et al. "Muscleblind localizes to nuclear foci of aberrant RNA in myotonic dystrophy types 1 and 2." Human molecular genetics 10.19 (2001): 2165-2170.
Mankodi, Ami, et al. "Myotonic dystrophy in transgenic mice expressing an expanded CUG repeat." Science 289.5485 (2000): 1769-1772.
Martorell, L., et al. "Frequency and stability of the myotonic dystrophy type 1 premutation." Neurology 56.3 (2001): 328-335.
McLane, L. M., Pulliam, K. F., Devine, S. E. & Corbett, A. H. The Ty1 integrase protein can exploit the classical nuclear protein import machinery for entry into the nucleus. Nucleic Acids Res 36, 4317-4326, doi:10.1093/nar/gkn383 (2008).
Michael P Robertson et al, "The Structure of a Rigorously Conserved RNA Element within the SARS Virus Genome", PLOS Biology, (Dec. 28, 2004), vol. 3, No. 1, doi:10.1371/journal.pbio.0030005, p. e5, XP055734415.
Nakamori, Masayuki, et al. "Splicing biomarkers of disease severity in myotonic dystrophy." Annals of neurology 74.6 (2013): 862-872.
Napierala, Marek, and Wlodzimierz J. Krzyzosiak. "CUG repeats present in myotonin kinase RNA form metastable "slippery" hairpins." Journal of Biological Chemistry 272.49 (1997): 31079-31085.
Nguyen Tuan M et al, "Virus against virus: a potential treatment for 2019-nCov (SARS-COV-2) and other RNA viruses", Cell Research, Nature Publishing Group, GB, CN, vol. 30, No. 3, doi:10.1038/S41422-020-0290-0, ISSN 1001-0602, (Feb. 18, 2020), pp. 189-190, (Feb. 18, 2020), XP037049278.

(56) References Cited

OTHER PUBLICATIONS

O'Brien, K., Matlin, A. J., Lowell, A. M. & Moore, M. J. The biflavonoid isoginkgetin is a general inhibitor of Pre-mRNA splicing. The Journal of biological chemistry 283, 33147-33154, doi:10.1074/jbc.M805556200 (2008).

O'Connell, M. R. Molecular Mechanisms of RNA Targeting by Cas13-containing Type VI CRISPR-Cas Systems. J Mol Biol 431, 66-87, doi:10.1016/j.jmb.2018.06.029 (2019).

Orkin, S. H., Cheng, T. C., Antonarakis, S. E. & Kazazian, H. H., Jr. Thalassemia due to a mutation in the cleavage-polyadenylation signal of the human beta-globin gene. The EMBO journal 4, 453-456 (1985).

Pedelacq, J. D., Cabantous, S., Tran, T., Terwilliger, T. C. & Waldo, G. S. Engineering and characterization of a superfolder green fluorescent protein. Nat Biotechnol 24, 79-88, doi:10.1038/nbt1172 (2006).

Poosala P, Lindley SR, Anderson KM, and Anderson DM. 2019. Targeting Toxic Nuclear RNA Foci with CRISPR-Cas13 to Treat Myotonic Dystrophy bioRxiv doi:10.1101/716514.

Rinn, J. L. & Chang, H. Y. Genome regulation by long noncoding RNAs. Annu Rev Biochem 81, 145-166, doi:10.1146/annurev-biochem-051410-092902 (2012).

Rund, D. et al. Two mutations in the beta-globin polyadenylylation signal reveal extended transcripts and new RNA polyadenylylation sites. Proceedings of the National Academy of Sciences of the United States of America 89, 4324-4328 (1992).

S. P. Moore, L. A. Rinckel, D. J. Garfinkel, A Ty1 integrase nuclear localization signal required for retrotransposition. Mol Cell Biol 18, 1105-1114 (1998).

S. Pellenz et al., New Human Chromosomal Sites with "Safe Harbor" Potential for Targeted Transgene Insertion. Hum Gene Ther 30, 814-828 (2019).

Sartini, B. L., Wang, H., Wang, W., Millette, C. F. & Kilpatrick, D. L. Pre-messenger RNA cleavage factor I (CFIm): potential role in alternative polyadenylation during spermatogenesis. Biol Reprod 78, 472-482, doi:10.1095/biolreprod.107.064774 (2008).

Shimazu, Tadahiro, Sueharu Horinouchi, and Minoru Yoshida. "Multiple histone deacetylases and the CREB-binding protein regulate pre-mRNA '-end processing." Journal of Biological Chemistry 282.7 (2007): 4470-4478.

Smargon, Aaron A., et al. "Cas13b is a type VI-B CRISPR-associated RNase differentially regulated by accessory proteins Csx27 and Csx28." Molecular cell 65.4 (2017): 618-630.

T Li et al., "siRNA targeting the Leader sequence of SARS-COV inhibits virus replication", Gene Therapy, GB, (Mar. 17, 2005), vol. 12, No. 9, doi:10.1038/sj.gt.3302479, ISSN 0969-7128, pp. 751-761, XP055734417.

Taneja, Krishan L., et al. "Foci of trinucleotide repeat transcripts in nuclei of myotonic dystrophy cells and tissues." The Journal of cell biology 128.6 (1995): 995-1002.

Thornton, Charles A., Eric Wang, and Ellie M. Carrell. "Myotonic dystrophy: approach to therapy." Current opinion in genetics & development 44 (2017): 135-140.

Tian, B. & Graber, J. H. Signals for pre-mRNA cleavage and polyadenylation. Wiley Interdiscip Rev RNA 3, 385-396, doi:10.1002/wrna. 116 (2012).

Tian, B. & Manley, J. L. Alternative polyadenylation of mRNA precursors. Nat Rev Mol Cell Biol 18, 18-30, doi:10.1038/nrm.2016.116 (2017).

Tian, B. I. N., et al. "Expanded CUG repeat RNAs form hairpins that activate the double-stranded RNA-dependent protein kinase PKR." RNA 6.1 (2000): 79-87.

Timothy R Abbott et al., "Development of CRISPR as a prophylactic strategy to combat novel coronavirus and influenza", BIORXIV, (Mar. 14, 2020), doi:10.1101/2020.03.13.991307, XP055733410.

Van Agtmaal, Ellen L., et al. "CRISPR/Cas9-induced (CTG · CAG) n repeat instability in the myotonic dystrophy type 1 locus: implications for therapeutic genome editing." Molecular therapy 25.1 (2017): 24-43.

Venkataraman, K., Brown, K. M. & Gilmartin, G. M. Analysis of a noncanonical poly(A) site reveals a tripartite mechanism for vertebrate poly(A) site recognition. Genes & development 19, 1315-1327, doi:10.1101/gad. 1298605 (2005).

Wang, Yanlin, et al. "Therapeutic genome editing for myotonic dystrophy type 1 using CRISPR/Cas9." Molecular Therapy 26.11 (2018): 2617-2630.

Wheeler, Thurman M., et al. "Correction of ClC-1 splicing eliminates chloride channelopathy and myotonia in mouse models of myotonic dystrophy." The Journal of clinical investigation 117.12 (2007): 3952-3957.

Wheeler, Thurman M., et al. "Targeting nuclear RNA for in vivo correction of myotonic dystrophy." Nature 488.7409 (2012): 111-115.

Wu, X. & Brewer, G. The regulation of mRNA stability in mammalian cells: 2.0. Gene 500, 10-21, doi:10.1016/j.gene.2012.03.021 (2012).

Xiang, K., Tong, L. & Manley, J. L. Delineating the structural blueprint of the pre-mRNA 3'-end processing machinery. Molecular and cellular biology 34, 1894-1910, doi:10.1128/MCB.00084-14 (2014).

Yadava, Ramesh S., et al. "MBNL1 overexpression is not sufficient to rescue the phenotypes in a mouse model of RNA toxicity." Human molecular genetics 28.14 (2019): 2330-2338.

Yang, Qin, et al. "Crystal structure of a human cleavage factor CFIm25/CFIm68/RNA complex provides an insight into poly (A) site recognition and RNA looping." Structure 19.3 (2011): 368-377.

Yang, Qin, Gregory M. Gilmartin, and Sylvie Doublié. "Structural basis of UGUA recognition by the Nudix protein CFIm25 and implications for a regulatory role in mRNA 3' processing." Proceedings of the National Academy of Sciences 107.22 (2010): 10062-10067.

Ying Dang et al., "Optimizing sgRNA structure to improve CRISPR-Cas9 knockout efficiency", Genome Biology, (Jan. 1, 2015), vol. 16, No. 280, doi:10.1186/s13059-015-0846-3, pp. 1-10, XP055369116.

Zahir Ali et al, "CRISPR/Cas13 as a Tool for RNA Interference", Trends in Plant Science, GB, (Mar. 28, 2018), vol. 23, No. 5, doi:10.1016/j.tplants.2018.03.003, ISSN 1360-1385, pp. 374-378, XP055680754.

Zhao, J., Hyman, L. & Moore, C. Formation of mRNA 3' ends in eukaryotes: mechanism, regulation, and interrelationships with other steps in mRNA synthesis. Microbiol Mol Biol Rev 63, 405-445 (1999).

Zhu, Y. et al. Molecular Mechanisms for CFIm-Mediated Regulation of mRNA Alternative Polyadenylation. Molecular cell 69, 62-74 e64, doi: 10.1016/j.molcel.2017.11.031 (2018).

Zu, Tao, et al. "Non-ATG-initiated translation directed by microsatellite expansions." Proceedings of the National Academy of Sciences 108.1 (2011): 260-265.

\* cited by examiner

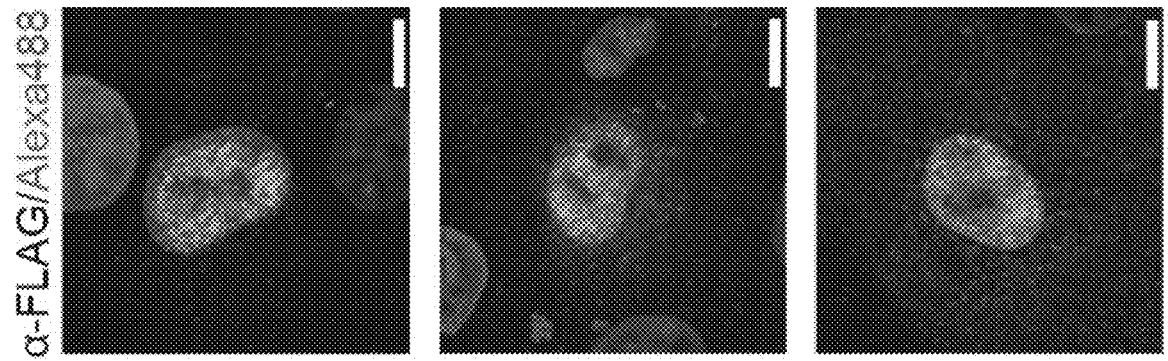
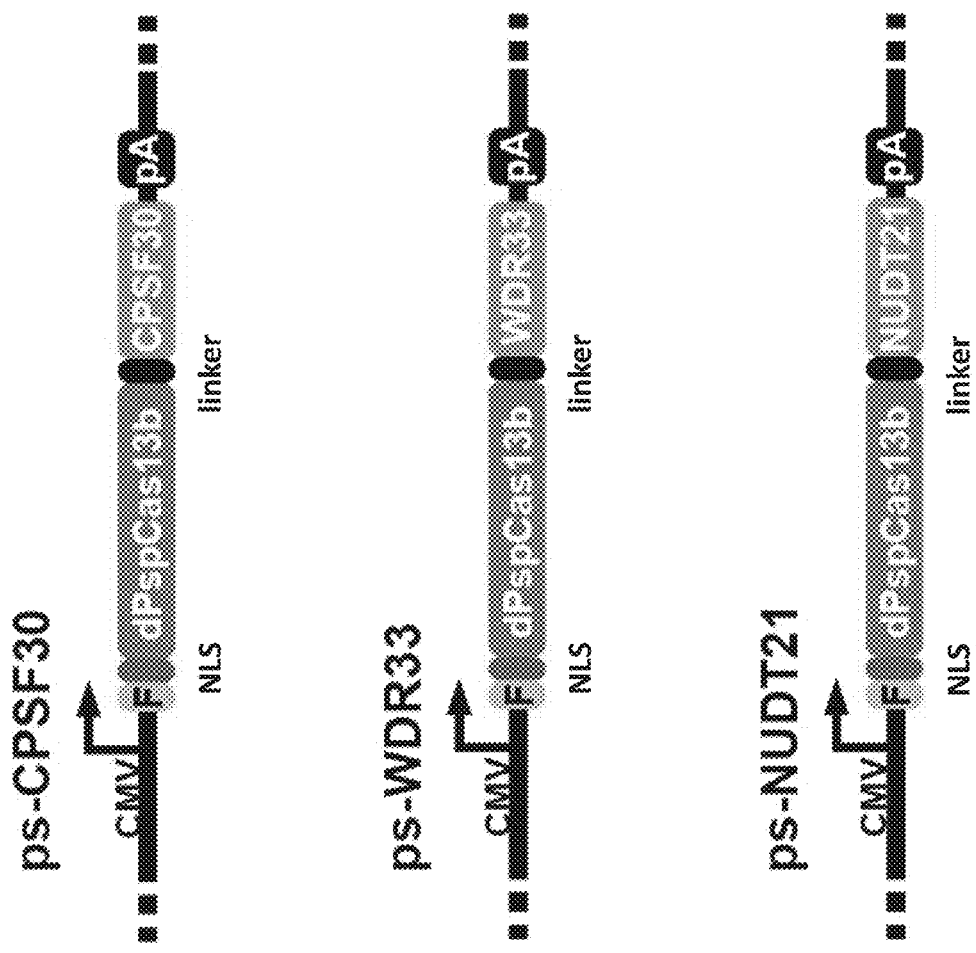
Figure 1

Fig. 2A sfGFPapa
 Fig. 2C *transcription*
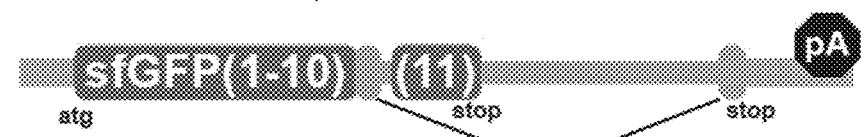
 *processing*
Fig. 2B sfGFP(1-10)    sfGFP(1-10)
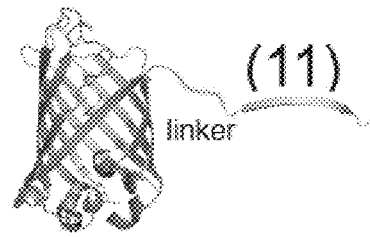 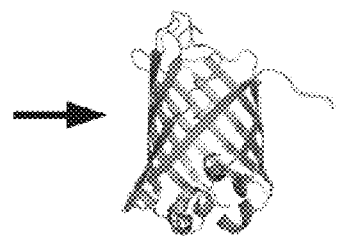
Figure 2

Fig. 2D
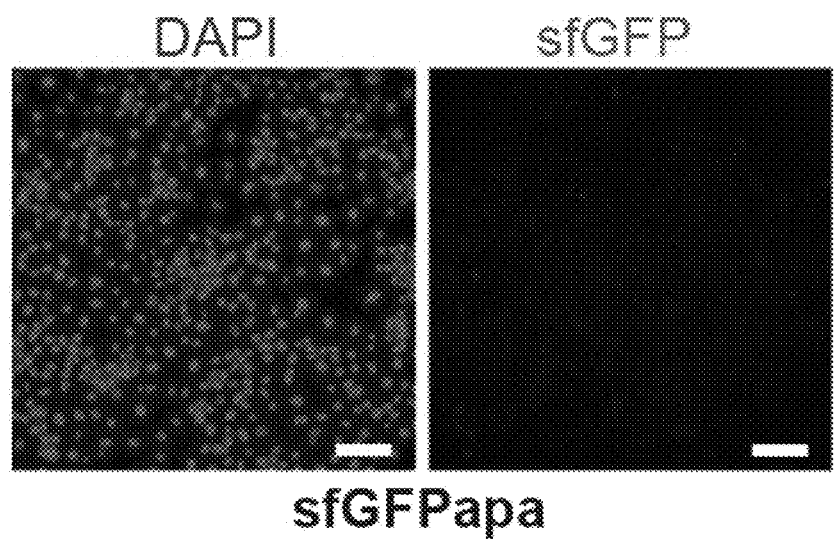
Fig. 2E
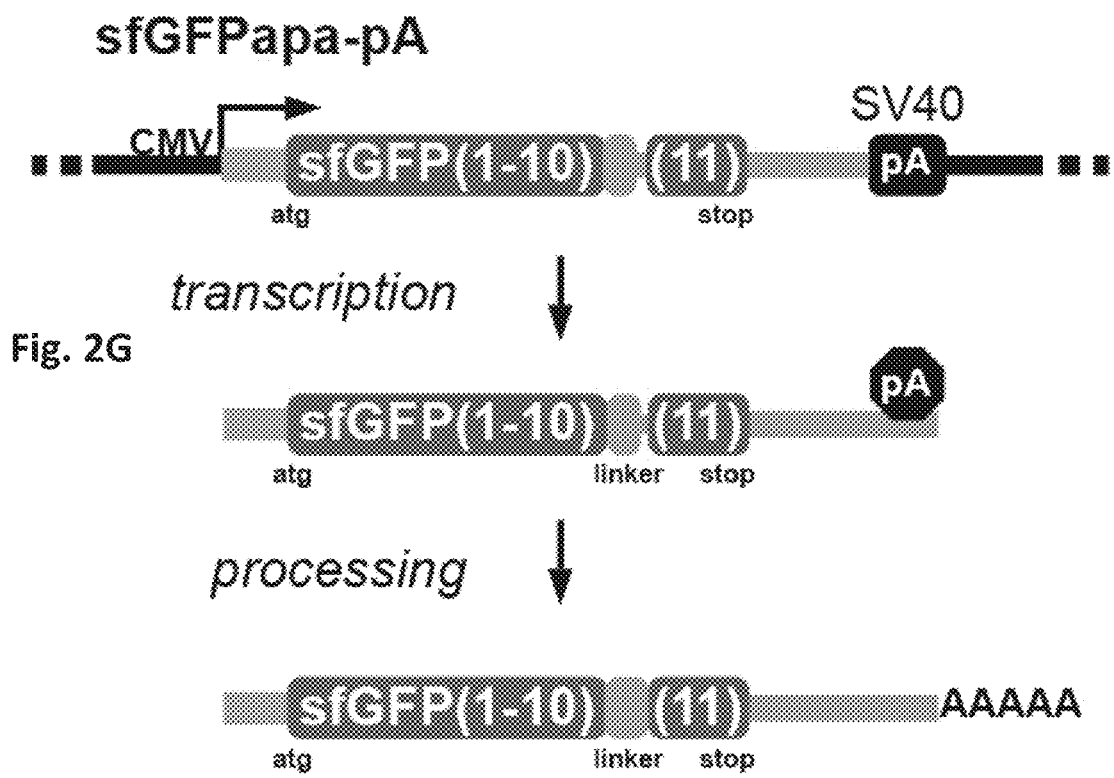
Figure 2 (cont'd)

Fig. 2F
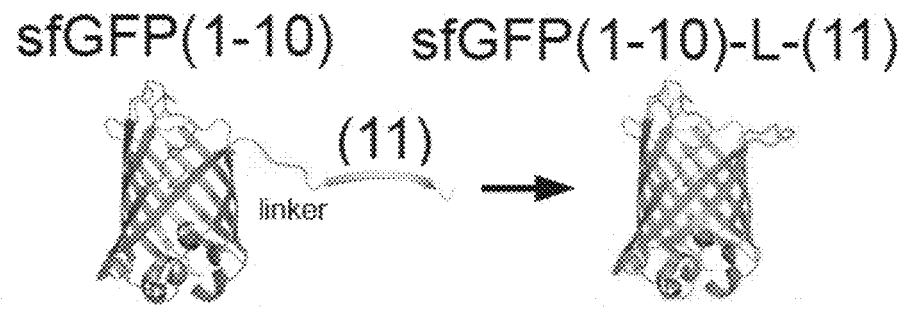
Fig. 2H
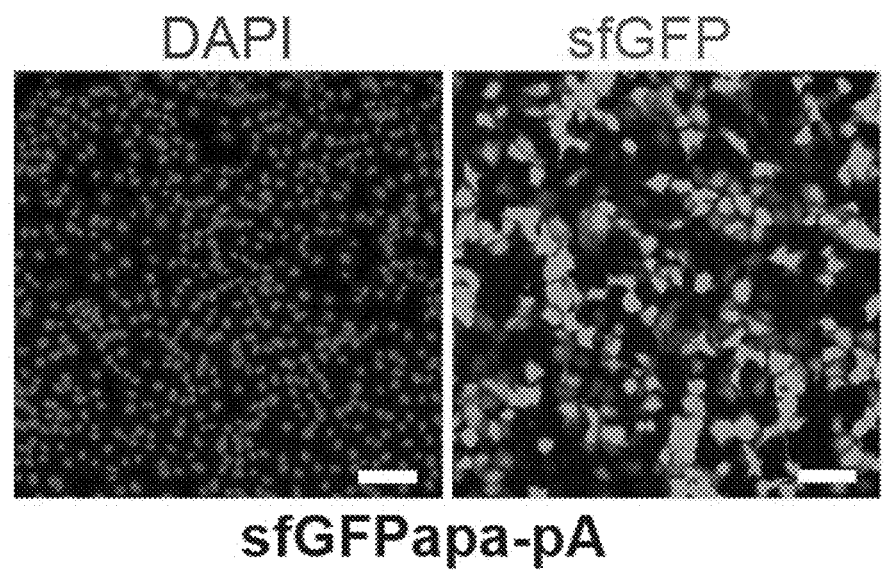
Figure 2 (cont'd)

Fig. 3A
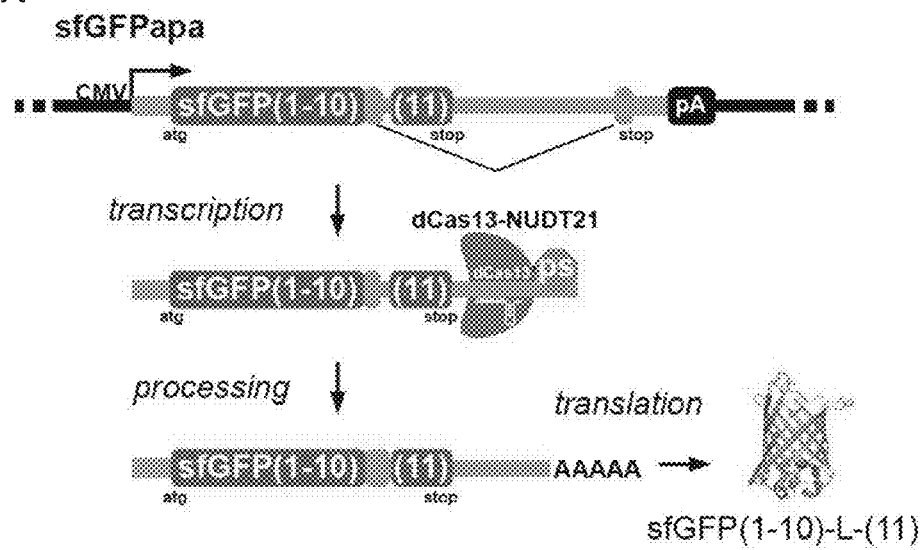
Fig. 3B
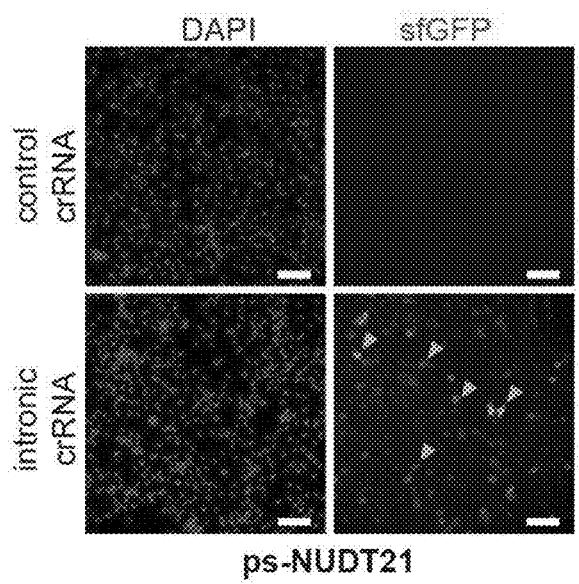
Fig. 3C
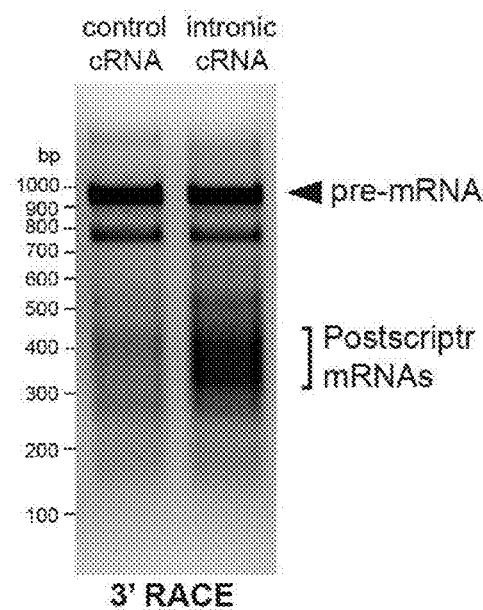
Figure 3

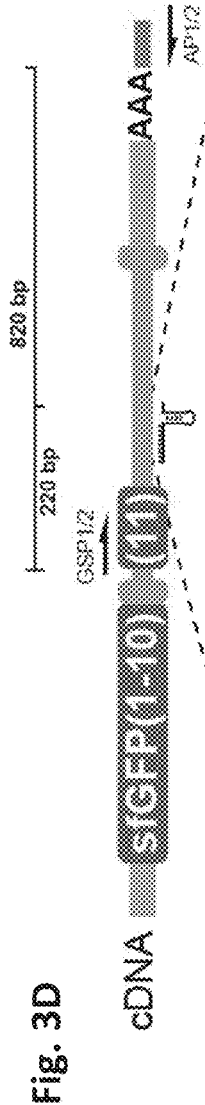
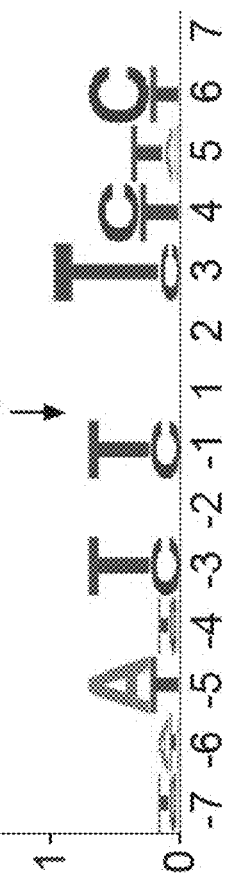
Figure 3 (cont'd)

Fig. 4A
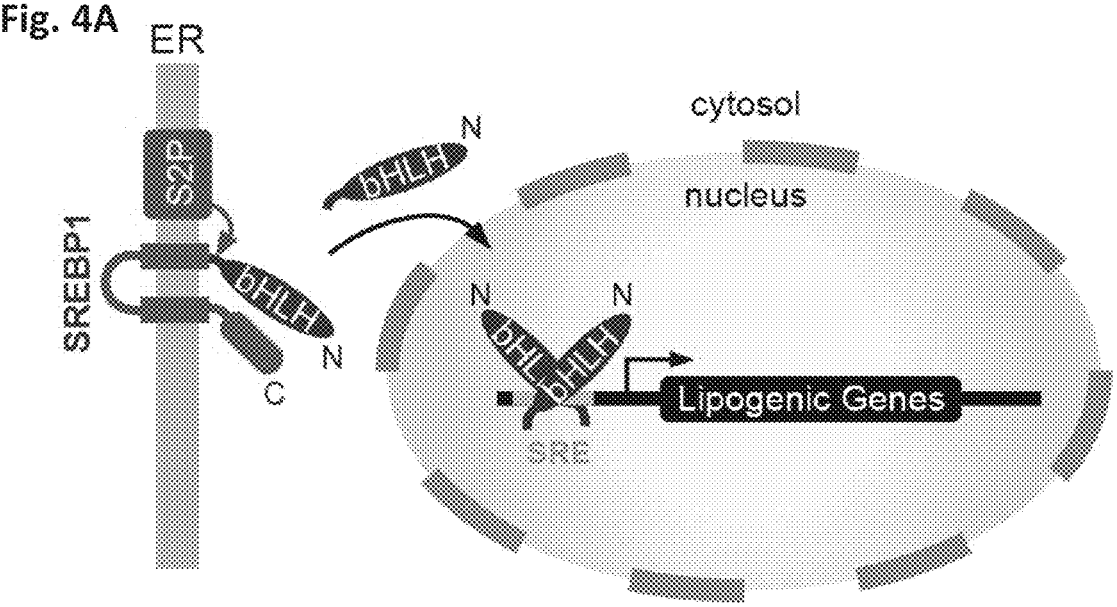
Fig. 4B
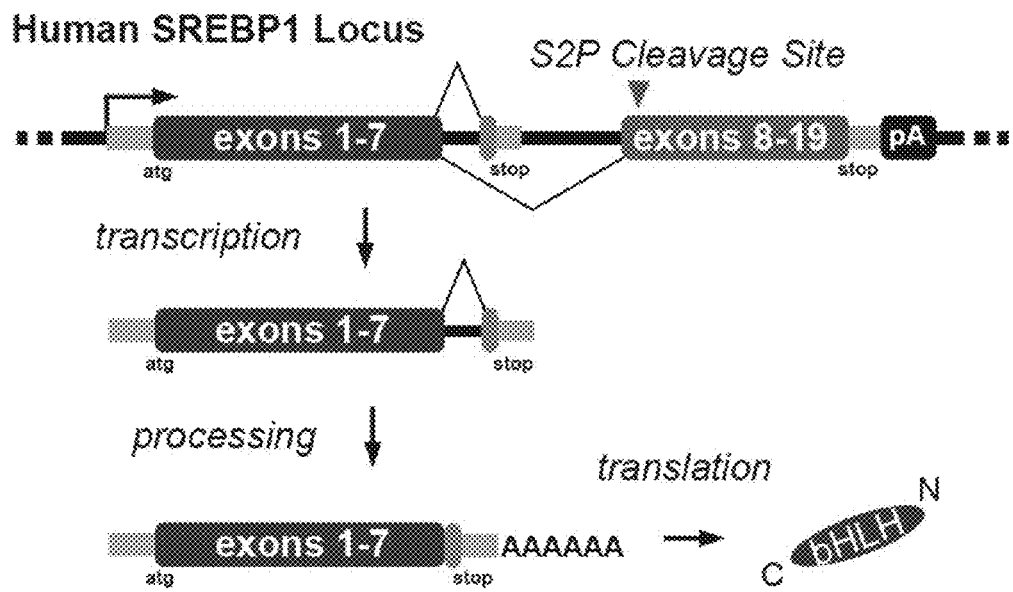
Fig. 4C
SREBP1 : –FEDSK AKPEQRPSLHSRGMLDRSRLALCTLVFL–   (SEQ ID NO:774)
SREBP1Δ: –FEDSK TE*  (SEQ ID NO:775)
440 ... S2P ... 472
Figure 4

Fig. 4D
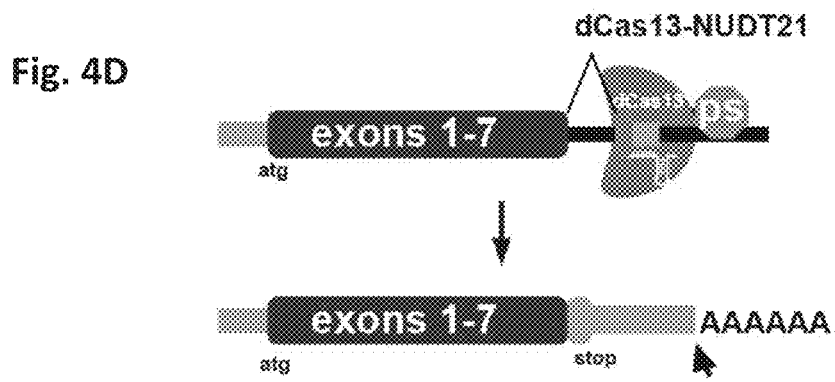
Fig. 4E
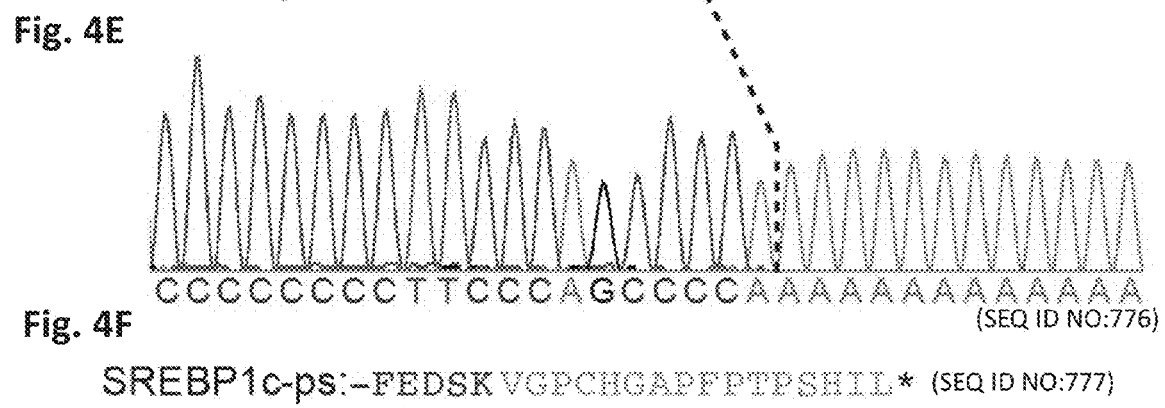
Fig. 4F
CCCCCCCTTCCCAGCCCCAAAAAAAAAAAAA (SEQ ID NO:776)
SREBP1c-ps:-FEDSKVGPCHGAPFPTPSHIL* (SEQ ID NO:777)
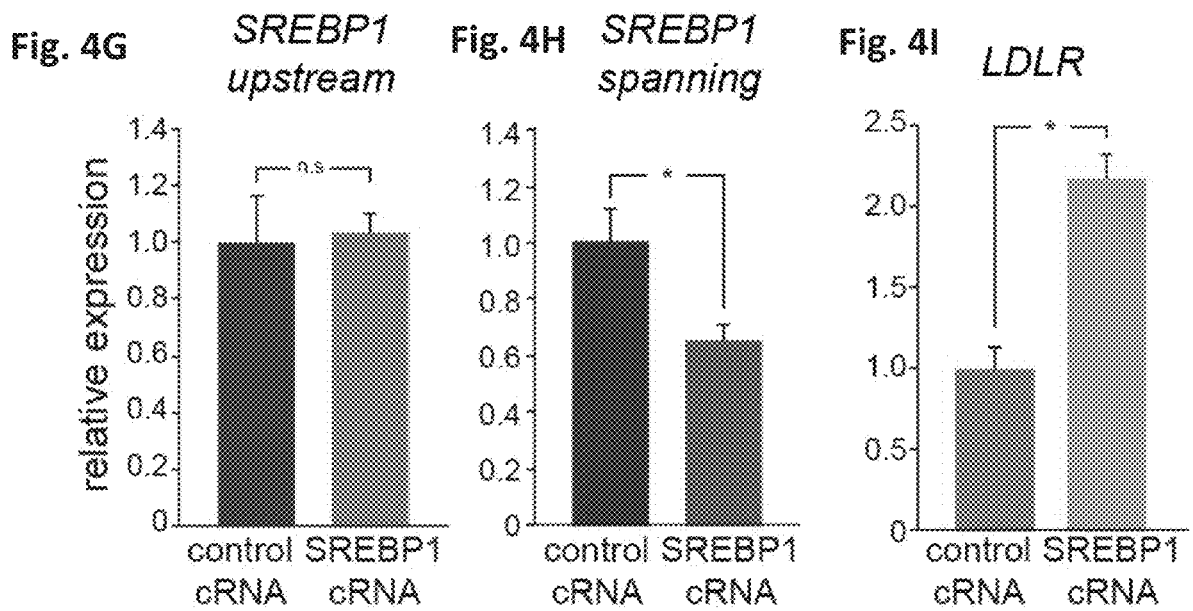
Fig. 4G SREBP1 upstream
Fig. 4H SREBP1 spanning
Fig. 4I LDLR
Figure 4 (cont'd)

Fig. 9B

Cas13b crRNA Direct Repeat (DR) Sequence

```
PspCas13b   5'- GTTGTGTGGAAGGTCCAGTTTTTGAGGGGCTATTACAAC -3'  (SEQ ID NO:778)
BzoCas13b   5'- GTTTGGAACTGCTCTCATTTTGAGGGTAATCACAAC   -3'  (SEQ ID NO:779)
PbTCas13b   5'- GTTTGCATCTGCCCTTCTTTTTGAAAGGTAAAAACAAC -3'  (SEQ ID NO:780)
```

Fig. 9C

PspCas13b crRNA

```
                                    Direct Repeat (DR)
                                   ┌─                    AG U
5'NNNNNNNNNNNNNNNNNNNNNNNNNNNNNGUUGUGGAAGGUCC  A  U
                                   |||||  ••  ||         U
                              3'CAACAUUAUCGGGA  G  U
```

(SEQ ID NO:781)

Figure 9 (cont'd)

Fig. 9D
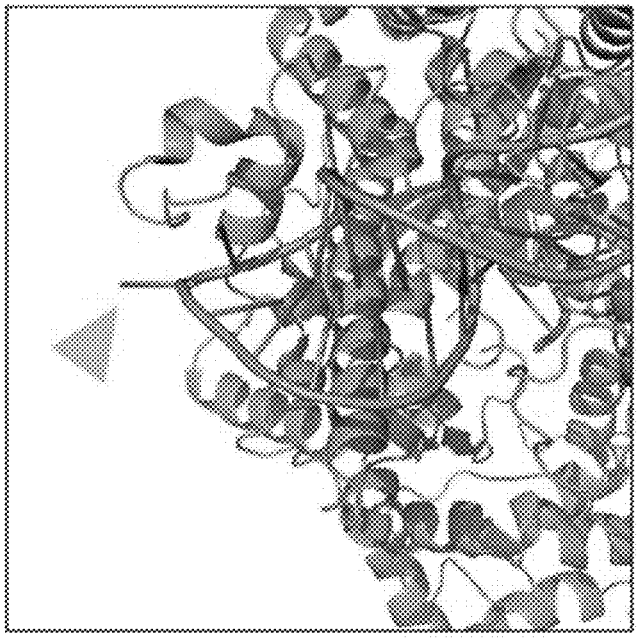
Fig. 9E
```
PspCas13b T17C  5'-GTTTGTGGAAGGTCCAGCTTTTGAGGGGCTATTACAAC-3' (SEQ ID NO:782)
PspCas13b T18C  5'-GTTTGTGGAAGGTCCAGTCTTTGAGGGGCTATTACAAC-3' (SEQ ID NO:783)
PspCas13b T19C  5'-GTTTGTGGAAGGTCCAGTTCTGAGGGGCTATTACAAC-3' (SEQ ID NO:784)
```
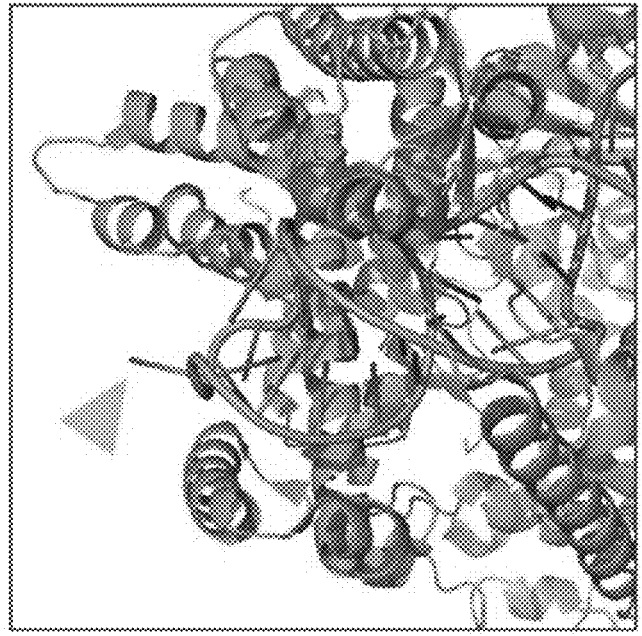
Figure 9 (cont'd)

```
Fly     MASSQVSNKSGSGWPRRGSQGQADAASSNNGTQKYTNQALTINRTINLYPLTNYTFGTK    60
Human   -MSVVPNRSQTGWPRGVTQFGNK----------YIQQTKPLTLERTINLYPLTNYTFGTK    50
Worm    -------MEDIWPTIERTTISA-----SVPEAPANFDEKPPFNKTINVYPLTNYTFGTK    47
                              **       :  :        : :*****:*********

Fly     EPLFEKDPSVPSRFQRMREEFDRIGMRRSVEGVLLVHEHGLPHVLLLQLGTTFFKLPGGE   120
Human   EPLYEKDSVAARFQRMREEFDKIGMRRTVEGVLLVHEHRLPHVLLLQLGTTFFKLPGGE   110
Worm    DAQAERDKSVPERFKRMKDEYEVMGMRRSVEAVLIVHEHSLPHILLLQIGTTFYKLPGGE   107
         *  *:*:** **:**::*::  :****:** ***:****..**:***:***:******

Fly     LNAGEDEVEGLKRLLSETLGRQDGVKQEWIVEDTIGNWWRPNFEPPQYPYIPPHITKPKE   180
Human   LNPGEDEVEGLKRLLSETLGRQDGVLQDWVTDDCIGNWWRPNFEPPQYPYIPAHITKPKE   170
Worm    LELGEDEISGVTRLLNETLGRTDGETNEWTIEDEIGNWRPNFDPPRYPYIPAHVTKPKE   167
        *: ****: .: :**.****** **  :::*: :*:  ***:**:****.:.*****

Fly     HKRLFLVQLHEKALFAVPKNYKLVAAPLFELYDNSQGYGPIISSLPQALCRFNFIYM---   237 (SEQ ID NO:53)
Human   HKKLFLVQLQEKALFAVPKNYKLVAAPLFELYDNAPGYGPIISSLPQLLSRFNFIYN---   227 (SEQ ID NO:51)
Worm    HTKLILVQLPSKSTFCVPKNFKLVAAPLFELYDNAAAYGPLFELYDMAAAYGPLTTLSRFNFIFNDSN   227 (SEQ ID NO:52)
        *.::::***   *: :****:***********  .:**::***** *:******:

Figure 10
```

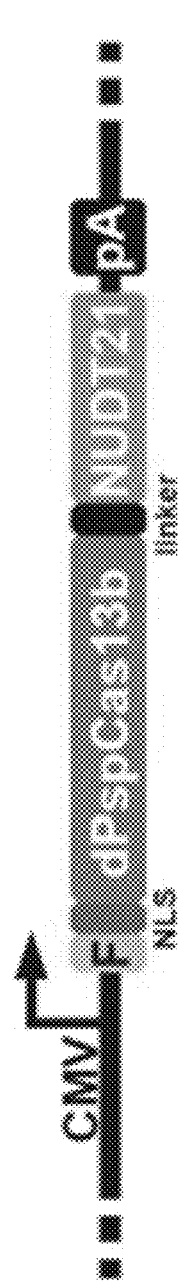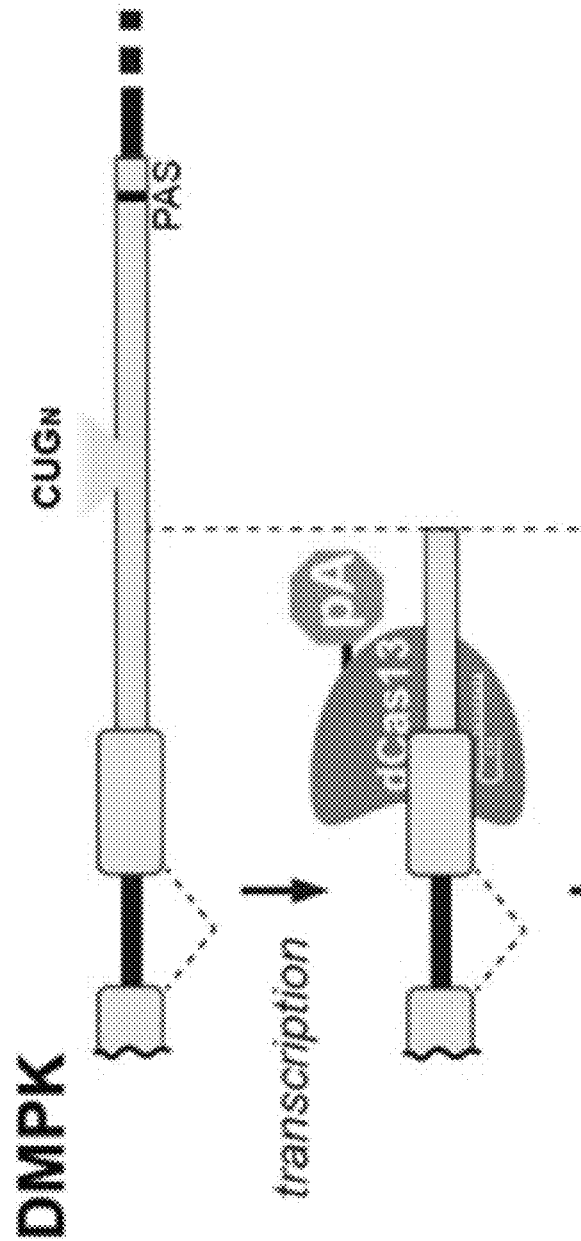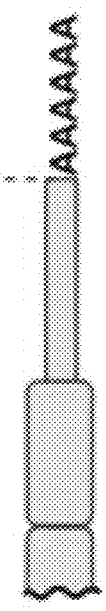
Fig. 13A
Fig. 13B
Figure 13

Fig. 13C
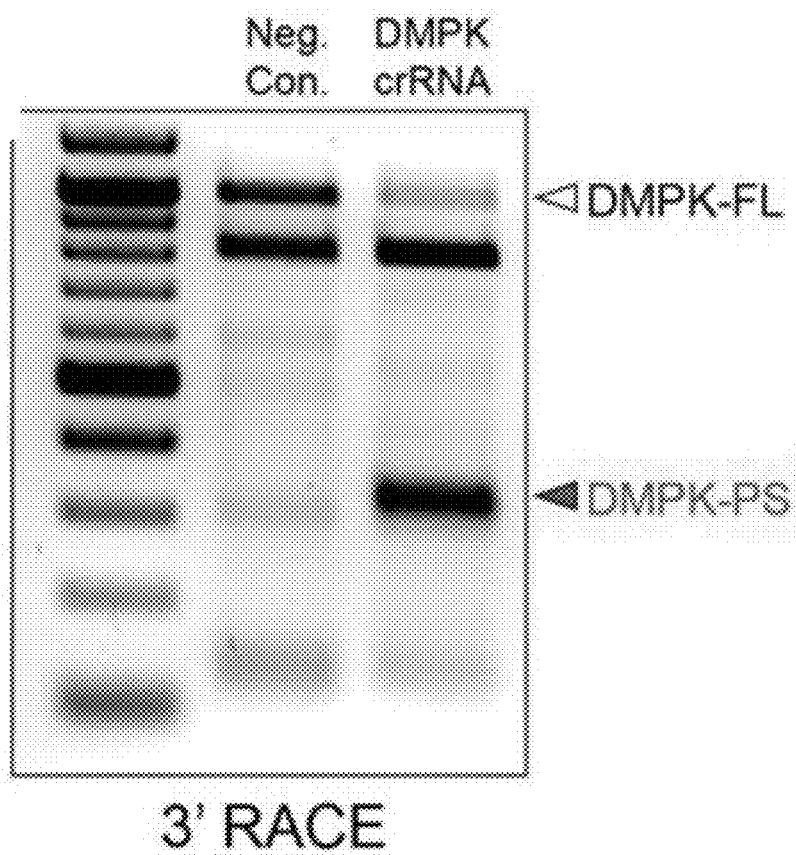
Fig. 13D
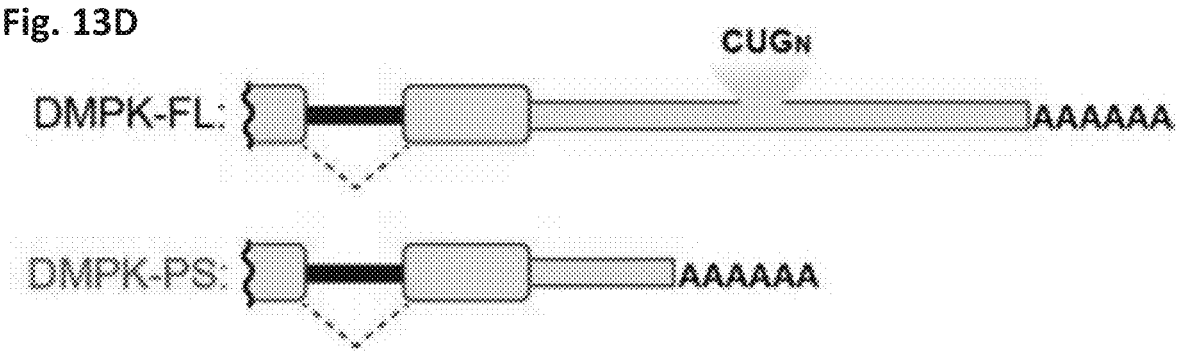
Figure 13 (cont'd)

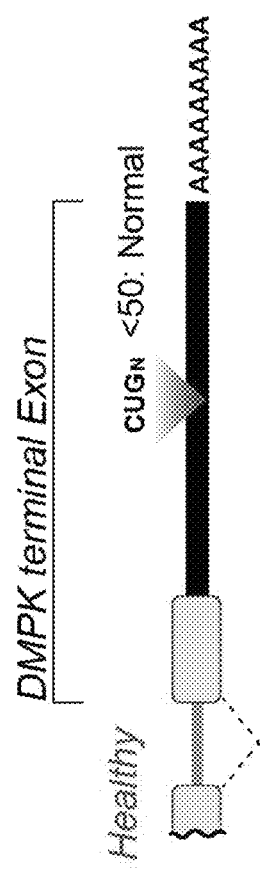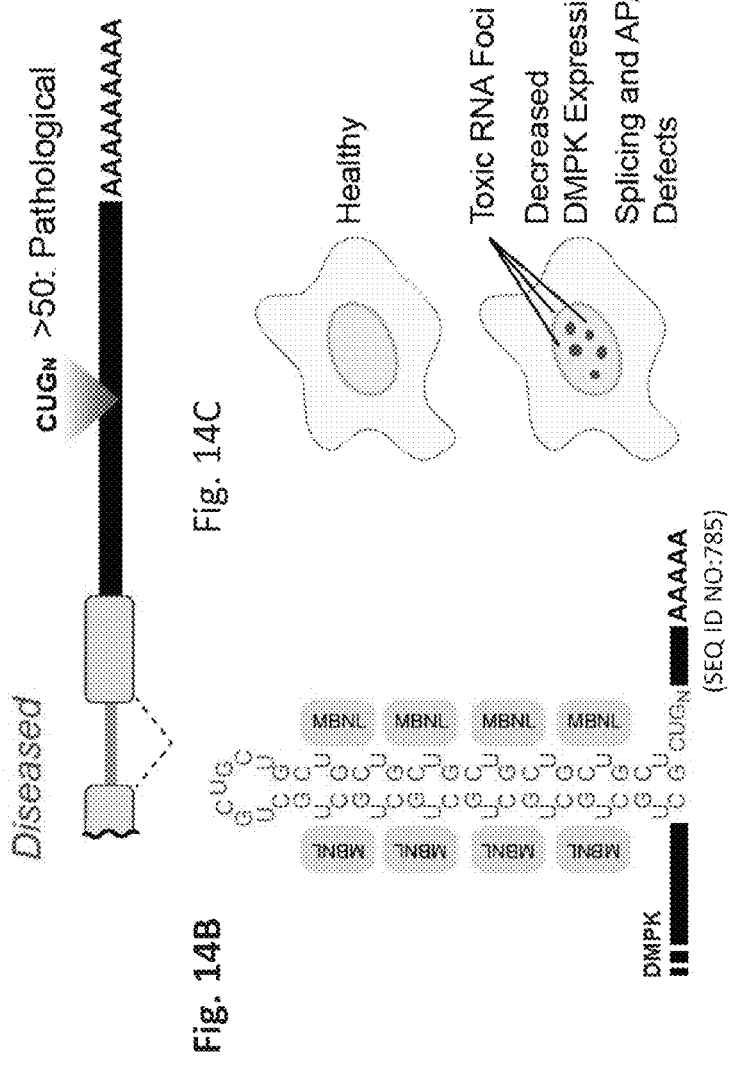
Figure 14

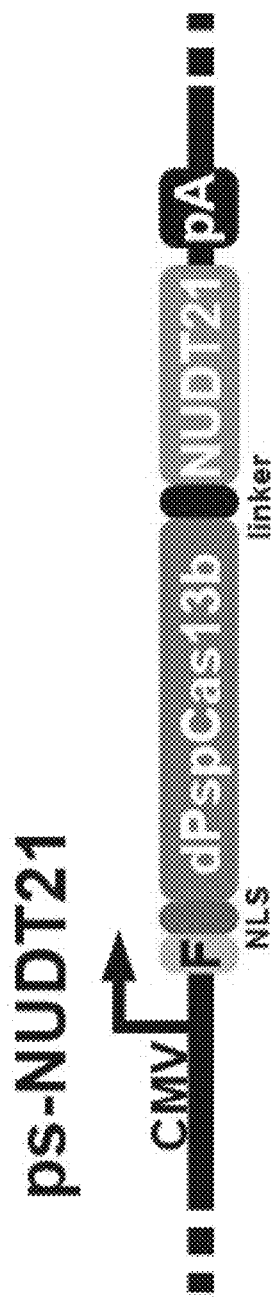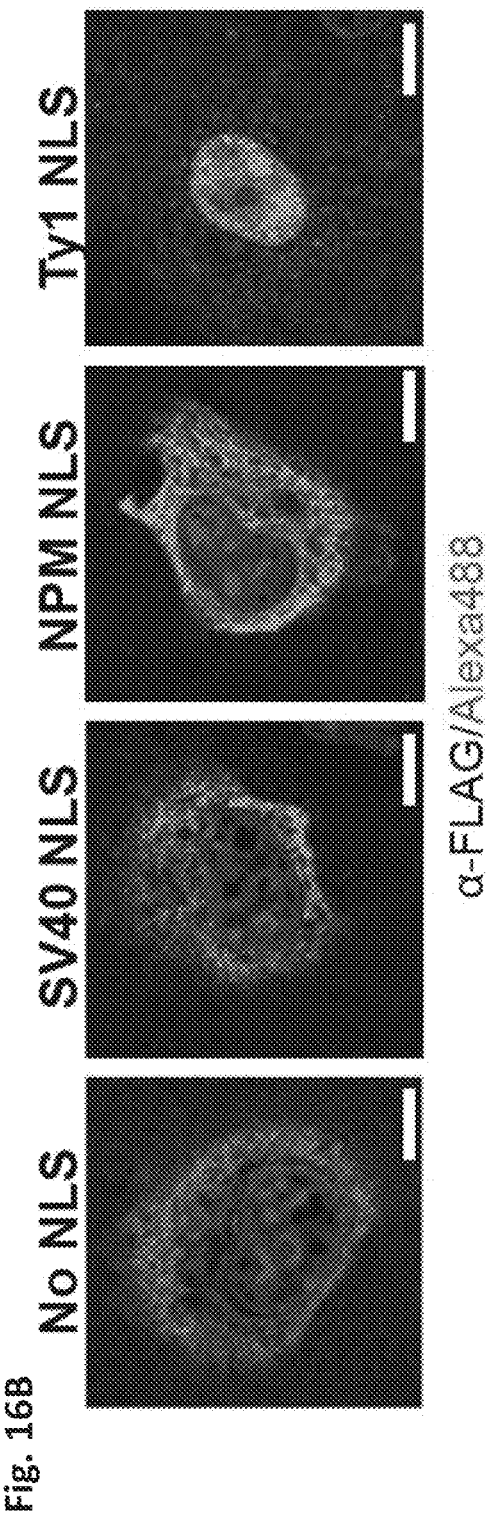
Fig. 16A
Fig. 16B
Figure 16

Fig. 17A sfGFPapa ps-NUDT21

Fig. 19A
HiLightr Green
Fig. 19B
DT960
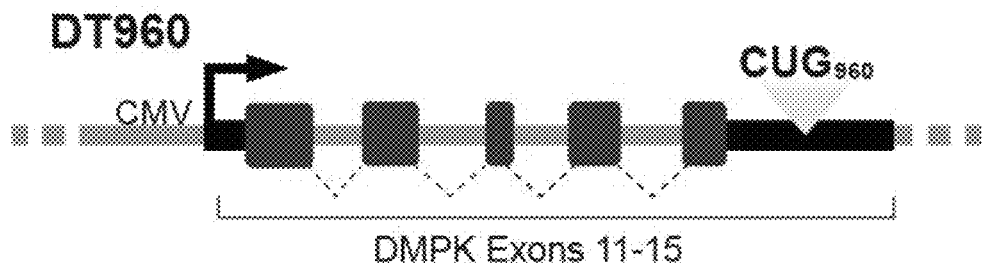
Fig. 19C
CAGx9 crRNA
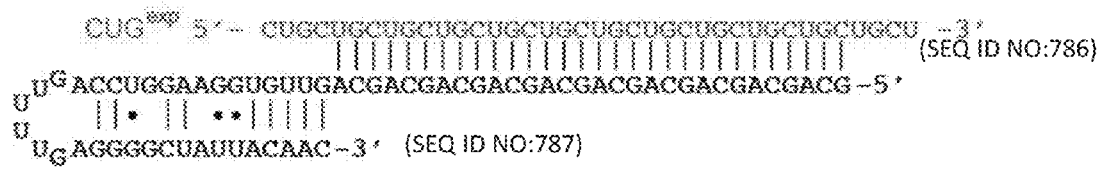
Figure 19

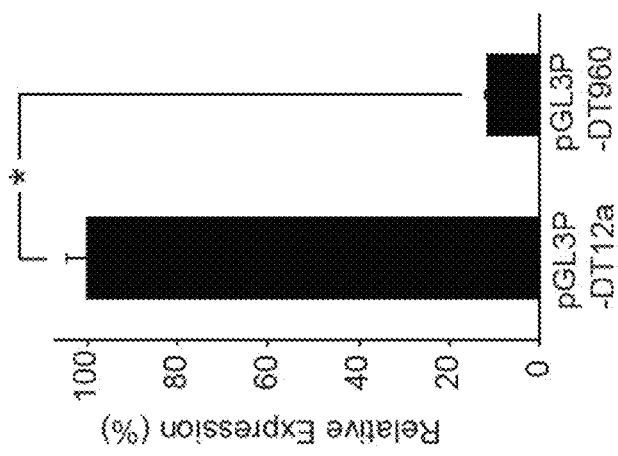
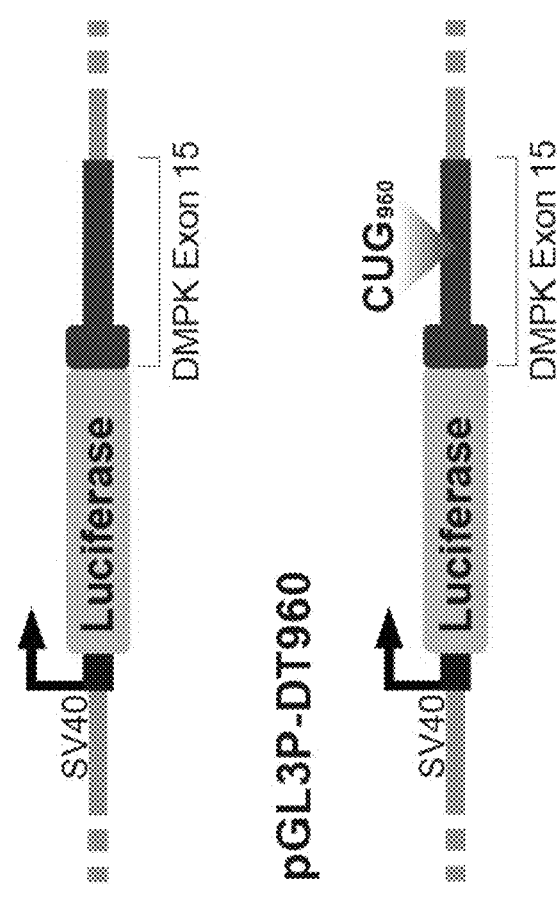
Figure 20

Fig. 21A
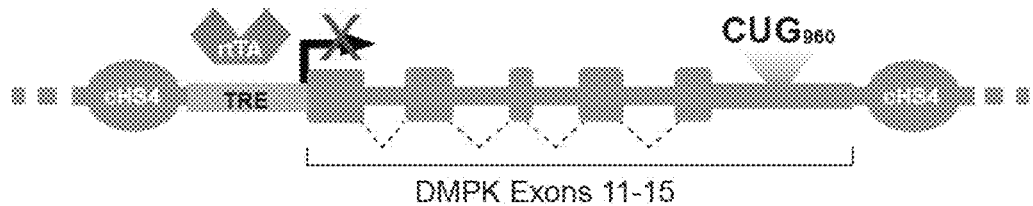
Fig. 21B
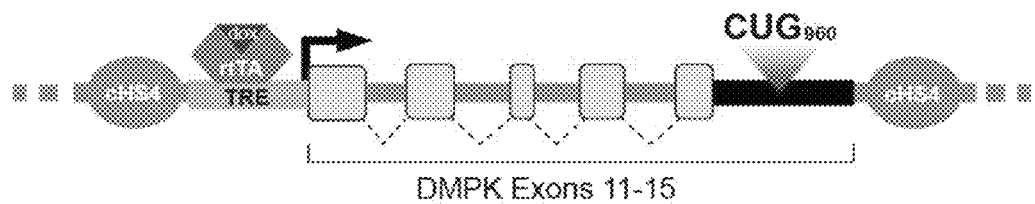
Fig. 21C
Fig. 21D
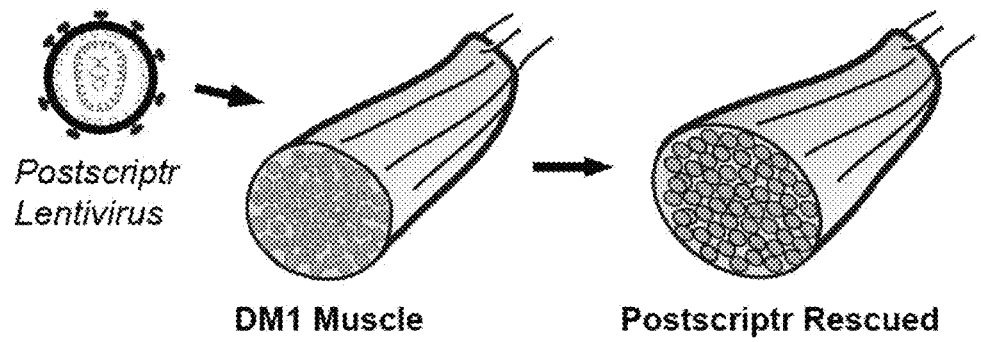
Figure 21

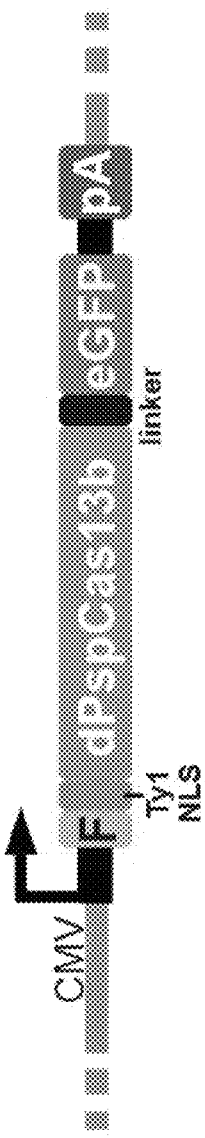
Fig. 22A
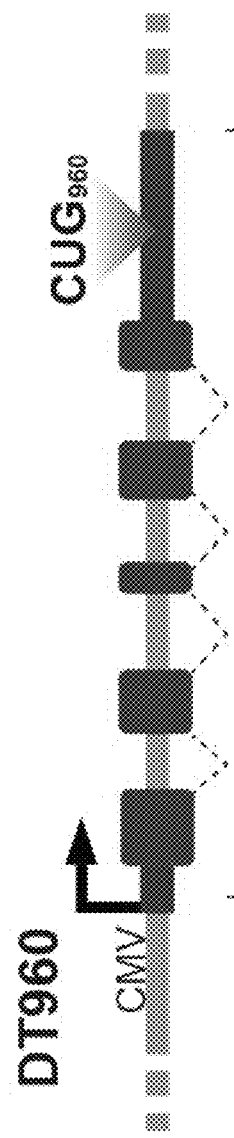
Fig. 22B
Fig. 22C
Figure 22

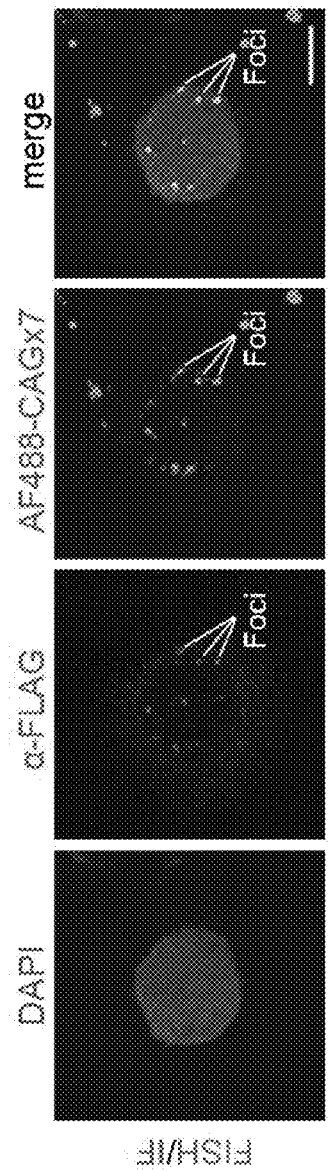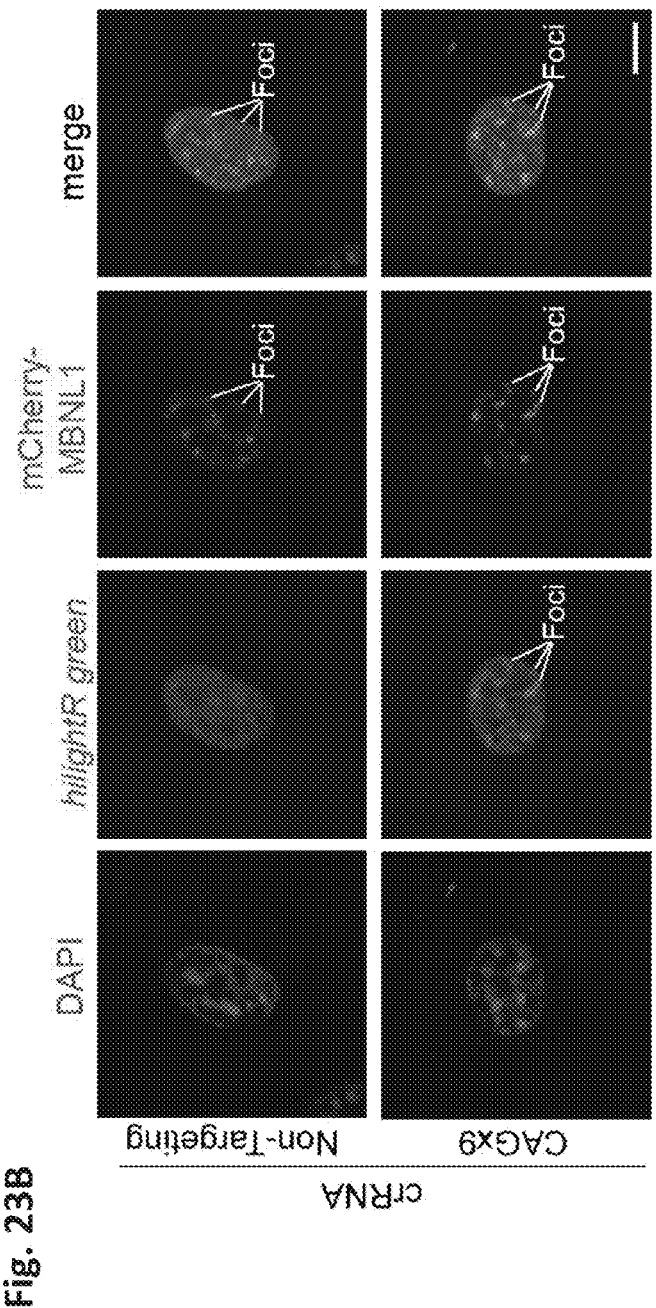
Fig. 23A
Fig. 23B
Figure 23

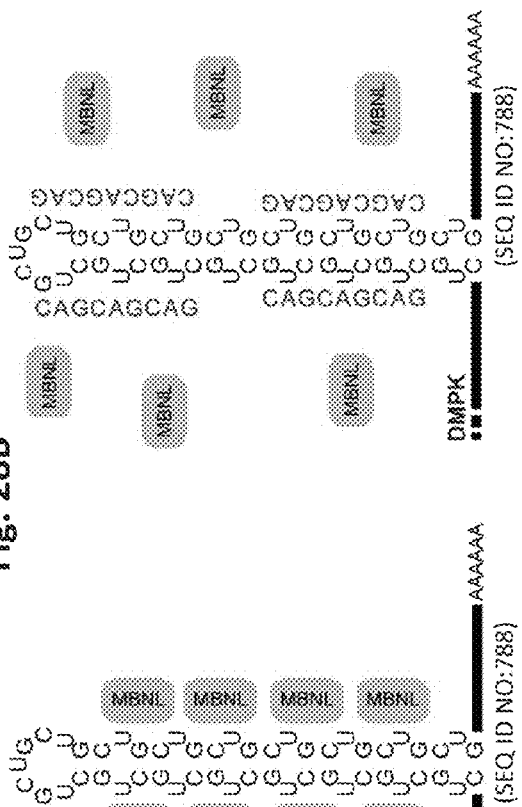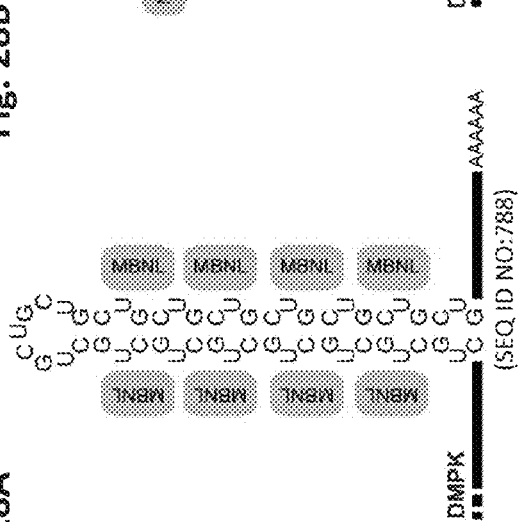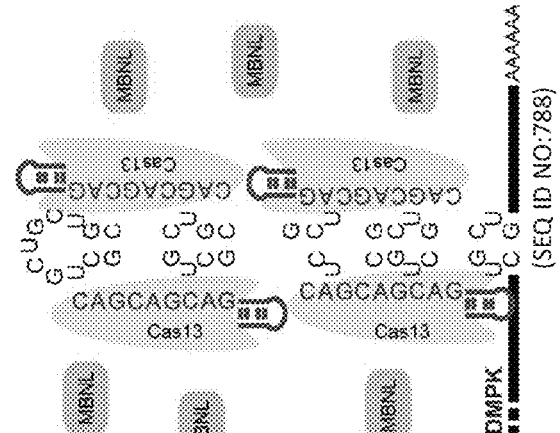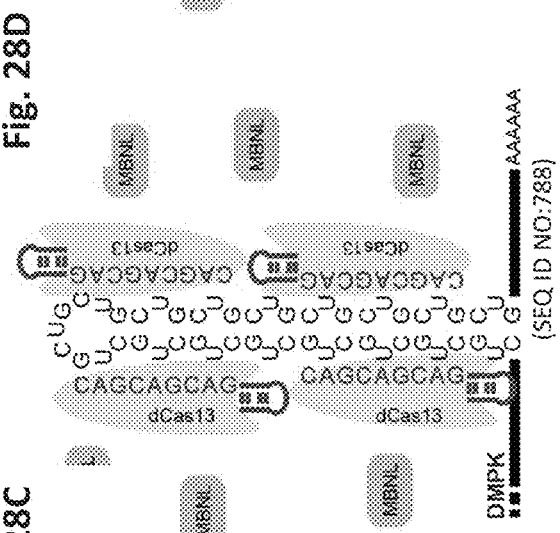
Figure 28

Fig. 30A
CUG960 Transgenic = OFF
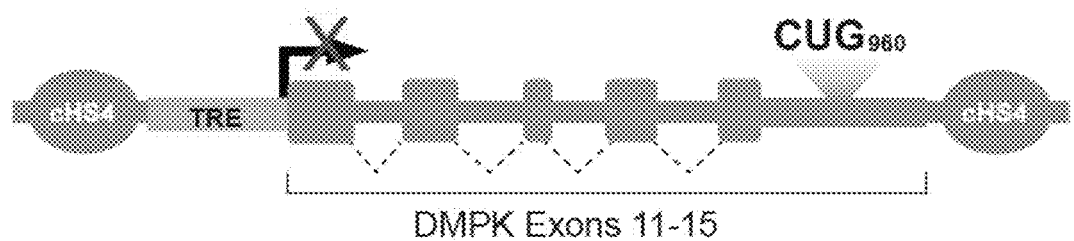
Fig. 30B
CUG960 + tTA Bi-Transgenic = ON
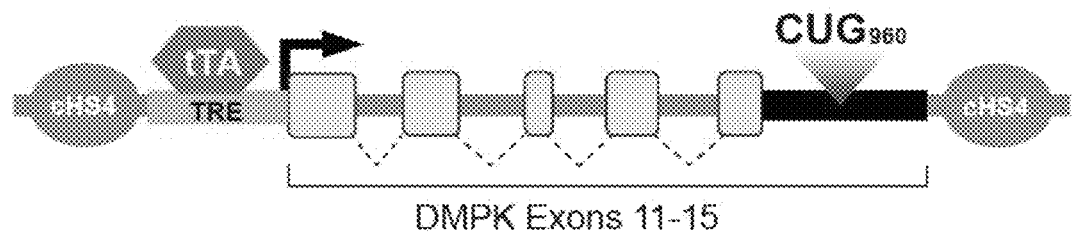
Fig. 30C
eraseR AAV9 Vector
Figure 30

Fig. 30D
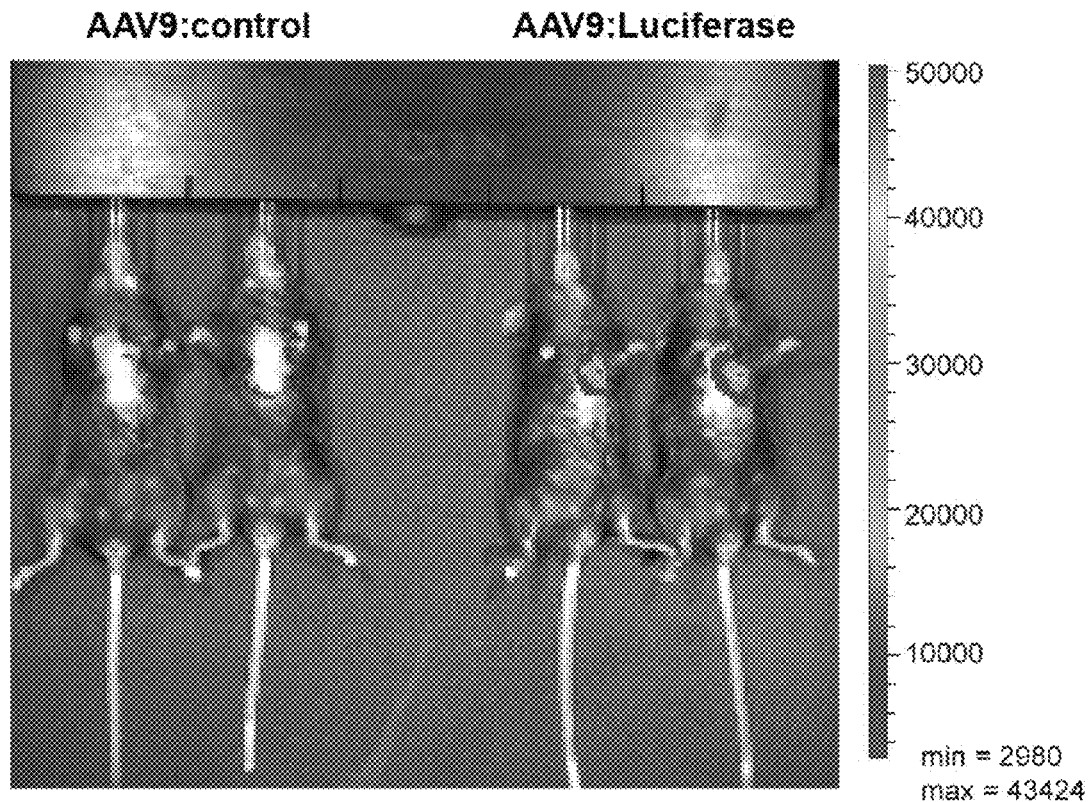
Fig. 30E
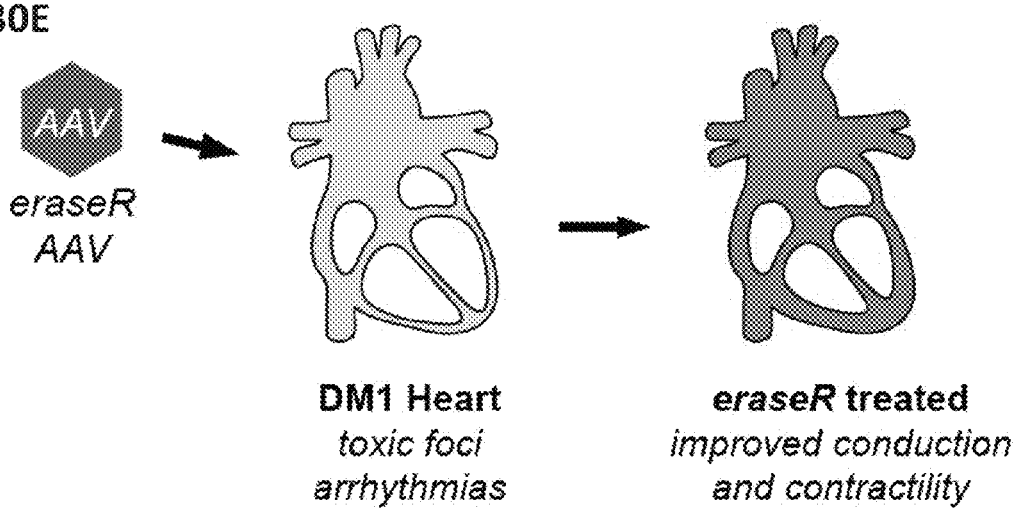
Figure 30 (cont'd)

Fig. 31A
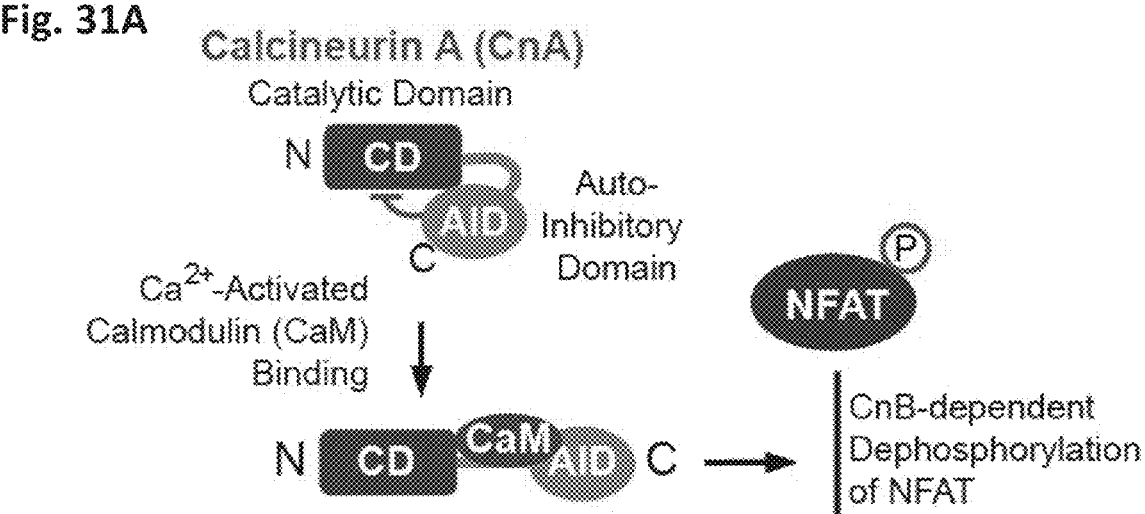
Fig. 31B
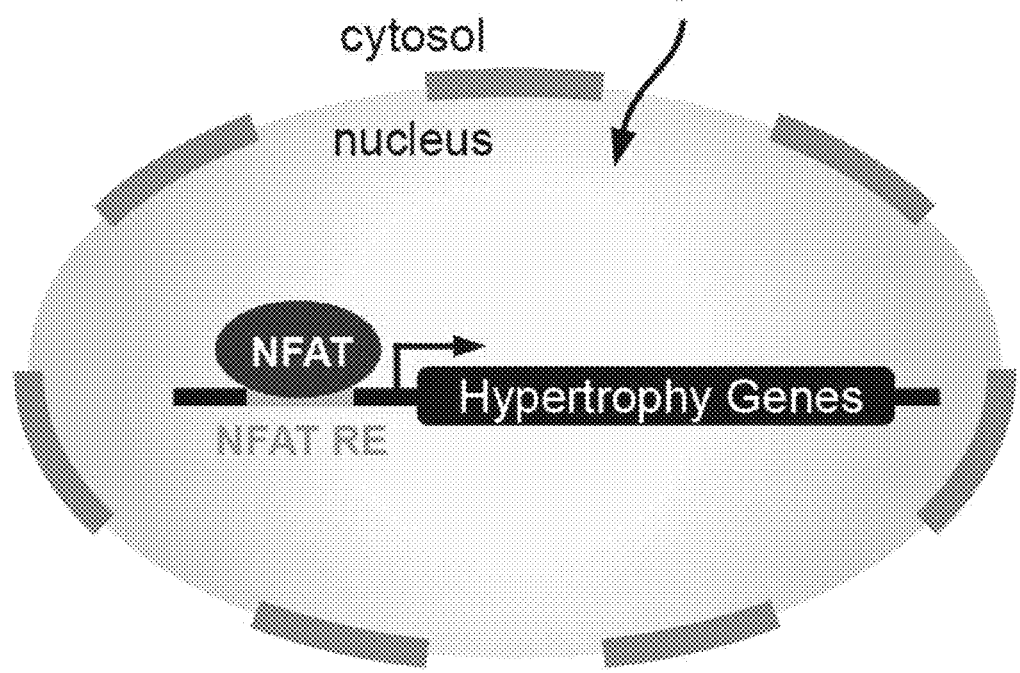
Figure 31

Fig. 31C
Human PPP3CB (Calcineurin A) Locus
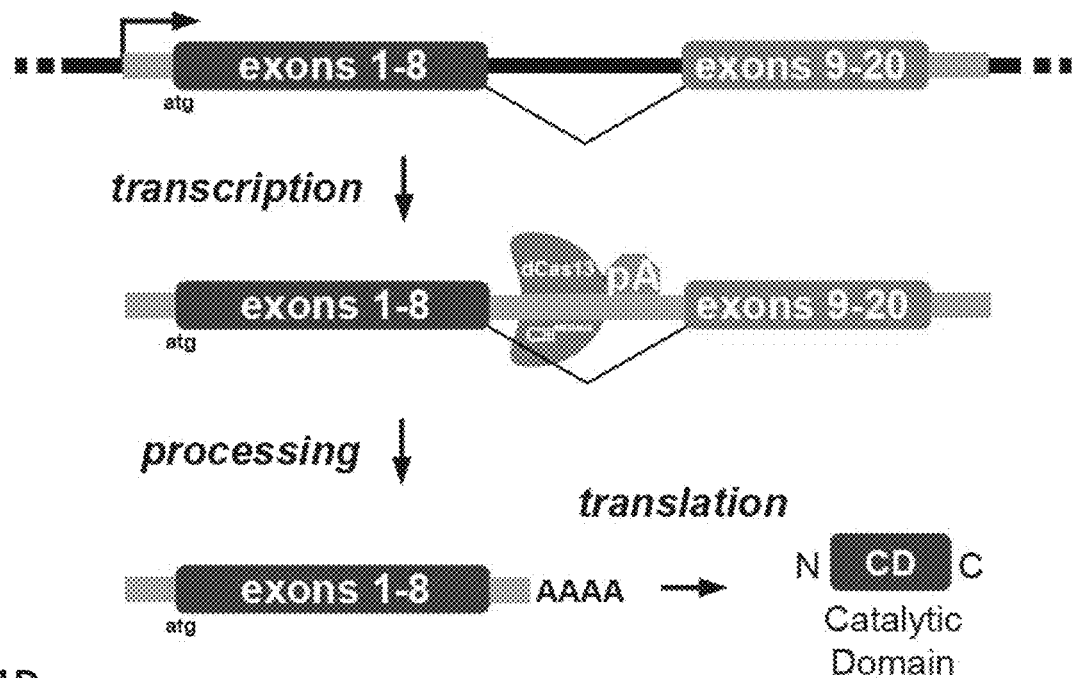
Fig. 31D
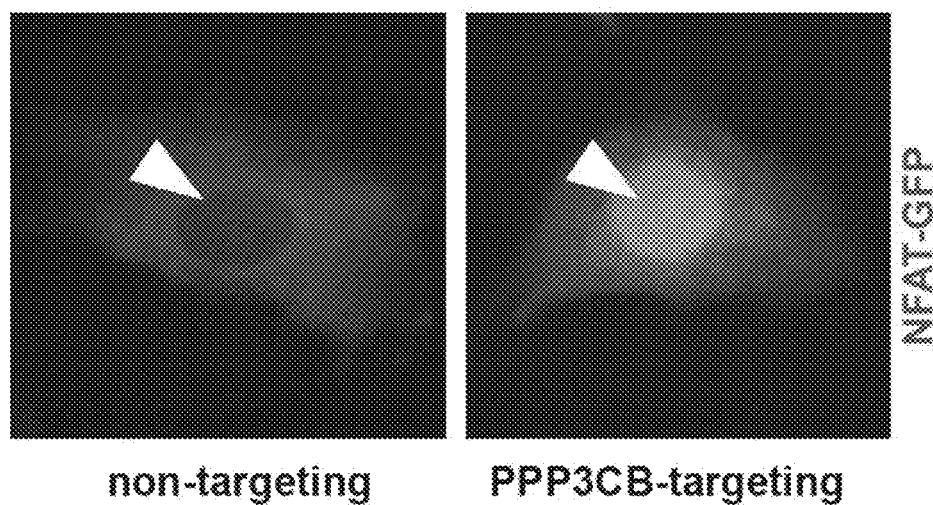
non-targeting     PPP3CB-targeting
Figure 31 (cont'd)

Fig. 32A
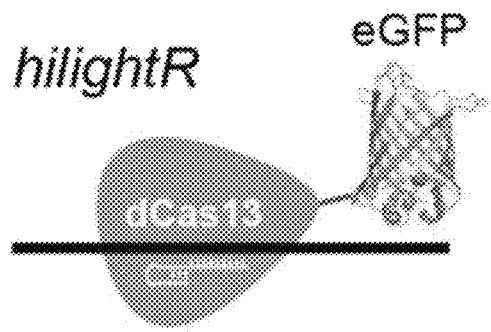
Fig. 32B
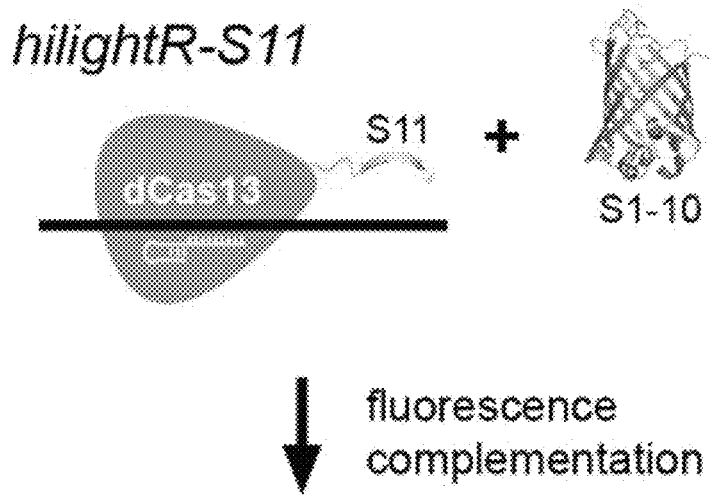
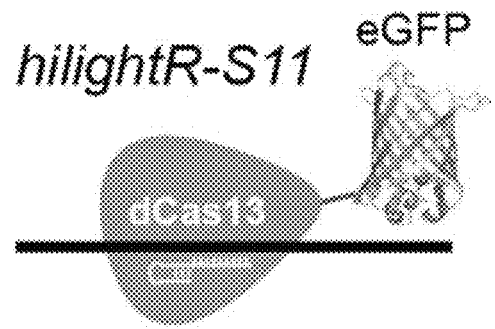
Figure 32

Fig. 32C
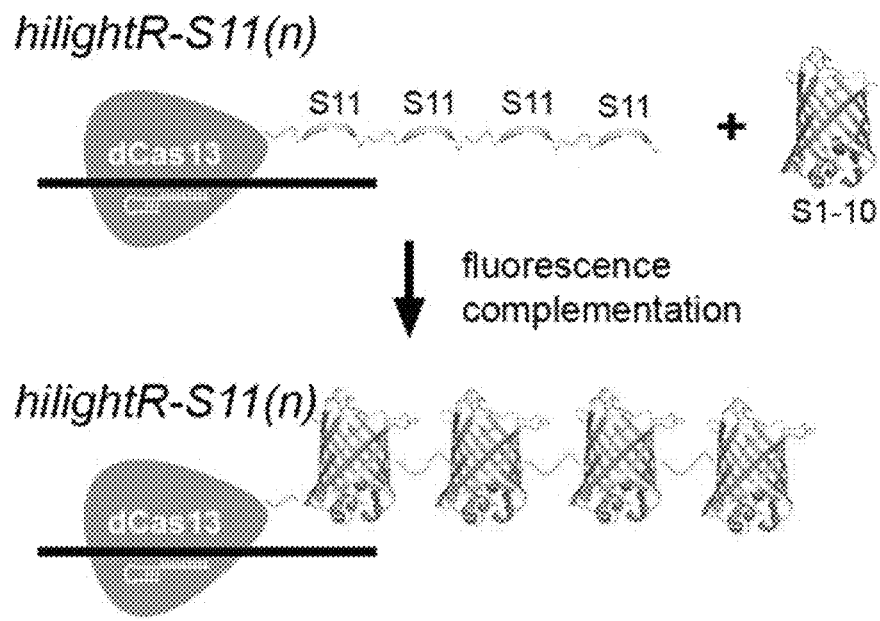
Fig. 32D
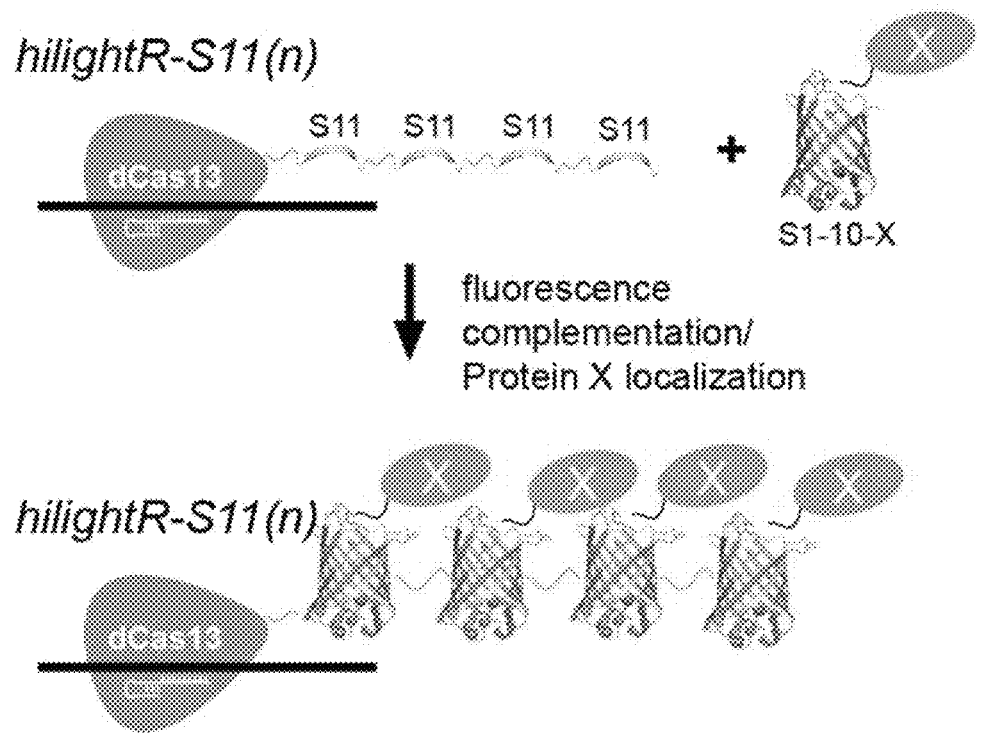
Figure 32 (cont'd)

Fig. 33A
dCas13b-NUDT21
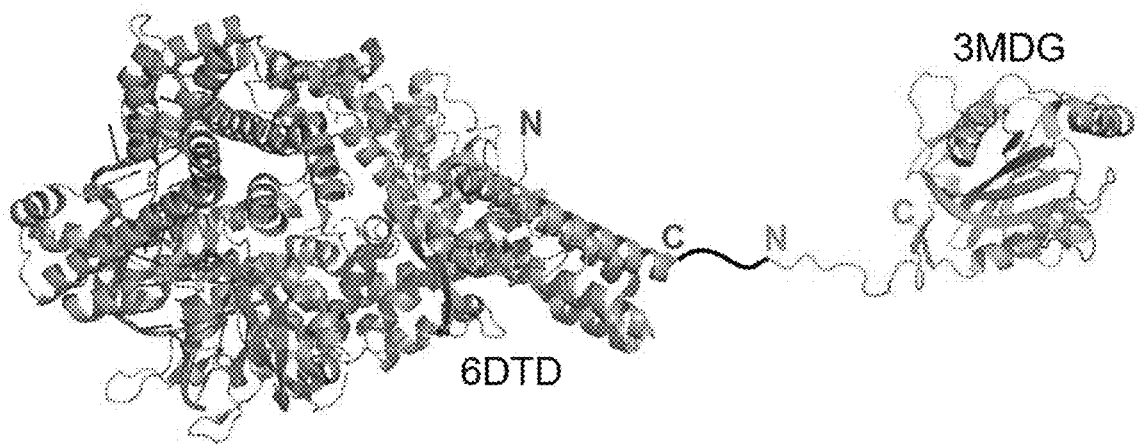
Fig. 33B
dCas13b-tdNUDT21 (tandem dimer)
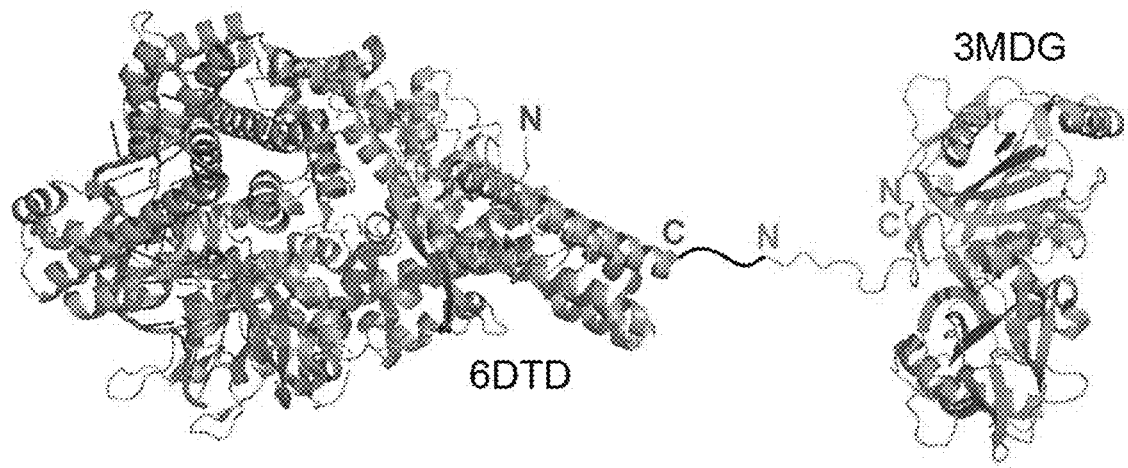
Figure 33

TARGETED NUCLEAR RNA CLEAVAGE AND POLYADENYLATION WITH CRISPR-CAS

CROSS-REFERENCE TO RELATED APPLICATIONS

This application is the U.S. national phase application filed under 35 U.S.C. § 371 claiming benefit to International Patent Application No. PCT/US2020/013577, filed on Jan. 14, 2020, which is entitled to priority to U.S. Provisional Application Ser. No. 62/791,971, filed on Jan. 14, 2019, and U.S. Provisional Application Ser. No. 62/877,415, filed on Jul. 23, 2019, each of which is incorporated by reference herein in its entirety.

BACKGROUND

The post-transcriptional cleavage and polyadenylation of messenger and long noncoding RNA is coordinated by a supercomplex of ~20 individual proteins within the eukaryotic nucleus (Mandel et al., Cell Mol Life Sci, 2008, 65:1099-1122; Xiang et al., Mol Cell Biol, 2014, 34:1894-1910). Polyadenylation plays an essential role in controlling RNA transcript stability, nuclear export, and translation efficiency (Colgan & Manley, Genes Dev, 1997, 11:2755-66; Guhaniyogi & Brewer, Gene, 2001, 265:11-23; Wu & Brewer, Gene, 2012, 500:10-21; Carmody & Wente, J Cell Sci, 2009, 122:1933-37). More than half of all human RNA transcripts contain multiple polyadenylation signal sequences that can undergo alternative cleavage and polyadenylation during development and cellular differentiation (Tian & Manley, Nat Rev Mol Cell Biol, 2017, 18:18-30; Elkon et al., Nat Rev Genet, 2013, 14:496-506). Alternative cleavage and polyadenylation is an important mechanism for the control of gene expression and defects in 3' end processing can give rise to myriad human diseases (Chang et al., Endocrinol Metab, 2017, 32:413-21; Curinha et al., Nucleus, 2014, 5:508-19).

Thus, there is a need in the art for compositions and methods for modulating alternative cleavage and polyadenylation. The present invention satisfies this need.

SUMMARY OF THE INVENTION

In one aspect, the invention provides a fusion protein comprising (a) a crisper-associated (Cas) protein; and (b) a cleavage and/or polyadenylation protein. In one embodiment, the Cas protein is catalytically dead Cas13 (dCas13). In one embodiment, dCas13 comprises a sequence selected from SEQ ID NOs: 47-48, or a variant thereof. In one embodiment, the cleavage or polyadenylation protein is NUDT21. In one embodiment, NUDT21 comprises a sequence selected from SEQ ID NOs: 51-58, or a variant thereof.

In one embodiment, the fusion protein further comprises a nuclear localization signal (NLS). In one embodiment, the NLS comprises a sequence selected from SEQ ID NOs: 75-695, or a variant thereof. In one embodiment, the fusion protein comprises a sequence selected from SEQ ID NOs: 696-698, or a variant thereof.

In on embodiment, the invention provides a method of modulating the cleavage, polyadenylation or both of an RNA transcript in a subject. In one embodiment, the method comprising administering to the subject: a fusion protein of the invention or the nucleic acid molecule encoding a method of the invention and a guide nucleic acid comprising a sequence complimentary to a target RNA sequence in the RNA transcript. In one embodiment, the method is an in vitro method. In one embodiment, the method is an in vivo method.

In one aspect, the invention provides a fusion protein comprising (a) a crisper-associated (Cas) protein; and (b) a florescent protein. In one embodiment, the Cas protein is catalytically dead Cas13 (dCas13). In one embodiment, dCas13 comprises a sequence selected from SEQ ID NOs: 47-48, or a variant thereof. In one embodiment, the fluorescent protein is selected from the group consisting of eGFP, mCherry, sfGFP, sfGFP(1-10), sfGFP(1-10)-L-(11), and 7xS11. In one embodiment, the fluorescent protein comprises a sequence selected from SEQ ID NO: 59-66, or a variant thereof.

In one embodiment, the fusion protein further comprises a nuclear localization signal (NLS). In one embodiment, the NLS comprises a sequence selected from SEQ ID NOs: 75-695, or a variant thereof. In one embodiment, the fusion protein comprises a sequence selected from SEQ ID NOs: 699-701, or a variant thereof.

In on embodiment, the invention provides a method of visualizing nuclear RNA in subject. In one embodiment, the method comprising administering to the subject: a fusion protein of the invention or the nucleic acid molecule encoding a method of the invention and a guide nucleic acid comprising a sequence complimentary to a target RNA sequence in the nuclear RNA transcript; and visualizing the nuclear RNA. In one embodiment, the method is an in vitro method. In one embodiment, the method is an in vivo method.

In one aspect, the invention provides a fusion protein comprising (a) a crisper-associated (Cas) protein; and (b) a NLS. In one embodiment, the Cas protein is Cas13. In one embodiment, Cas13 comprises a sequence selected from SEQ ID NOs: 1-46, or a variant thereof. In one embodiment, the NLS comprises a sequence selected from SEQ ID NOs: 75-695, or a variant thereof. In one embodiment, the fusion protein comprises a sequence of SEQ ID NOs: 702, or a variant thereof.

In one embodiment, the invention provides a method of decreasing the number of a nuclear RNA or cleaving nuclear RNA in a subject. In one embodiment, the method comprises comprising administering to the subject: a fusion protein of the invention or the nucleic acid molecule encoding a method of the invention and a guide nucleic acid comprising a sequence complimentary to a target RNA sequence in the nuclear RNA. In one embodiment, the method is an in vitro method. In one embodiment, the method is an in vivo method.

In one embodiment, the invention provides a nucleic acid encoding a fusion protein of the invention.

In one embodiment, the invention provides a use of the fusion protein of the invention or a nucleic acid molecule of the invention in the manufacture of a medicament. In one embodiment, the invention provides a use of the fusion protein of the invention or a nucleic acid molecule of the invention in the treatment of a disease or disorder associated with RNA.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 1, comprising FIG. 1A and FIG. 1B depicts the design and expression of fusion proteins encoding catalytically dead Cas13 and human polyadenylation complex factors. FIG. 1A depicts a diagram of the vectors encoding fusions between catalytically dead PspCas13b and components of the mammalian polyadenylation supercomplex, CPSF30, WDR33, and NUDT21. F—3×FLAG epitope; NLS—Ty1 nuclear localization sequence; pA—SV40 polyadenylation sequence. FIG. 1B depicts immunohistochemistry using a primary anti-FLAG antibody and an Alexa488 conjugated secondary antibody detecting the nuclear localization of the dPspCas13b fusion proteins expressed in mammalian COS7 cells. Scale bars in B, 10 μm.

FIG. 2, comprising FIG. 2A through FIG. 2H, depicts the design and generation of a fluorescent reporter for RNA cleavage and polyadenylation in mammalian cells. FIG. 2A depicts a diagram of the sfGFPapa reporter plasmid. FIG. 2B depicts the green fluorescent protein superfolder GFP (sfGFP) which forms a beta barrel composed of 11 beta strands. Removal of the $11^{th}$ beta strand abolishes fluorescence. FIG. 2C depicts transcription of the sfGFPapa reporter and processing of the resulting transcript which removes the coding sequence of the $11^{th}$ sfGFP beta strand. FIG. 2D demonstrates that the removal of the $11^{th}$ beta strand results in a lack of fluorescent signal in mammalian cells. FIG. 2E depicts a diagram of the sfGFPapa-pA reporter plasmid, which contains an upstream polyadenylation sequence. FIG. 2F is a schematic depicting that sfGFP can tolerate linker sequences between the $10^{th}$ and $11^{th}$ beta strands without abolishing fluorescence. FIG. 2G depicts transcription of the sfGFPapa-pA reporter and processing of the resulting transcript. FIG. 2H demonstrates that processed transcripts result in robust green fluorescence due to translation of the sfGFP(1-10)-L-(11) functional open reading frame. Scale bars in FIG. 2D and FIG. 2H, 100 μm.

FIG. 3, comprising FIG. 3A through FIG. 3F, depicts CRISPR-Cas13-mediated cleavage and polyadenylation of a reporter mRNA in mammalian cells. FIG. 3A depicts a diagram showing the Postscriptr targeting strategy to induce alternative cleavage and polyadenylation of the sfGFPapa reporter construct. A crRNA was designed to target an intronic sequence downstream of the coding sequence of the $11^{th}$ beta strand of sfGFP. FIG. 3B depicts expression of the dPspCas13b-NUDT21 fusion protein and demonstrates that intronic targeting crRNA resulted in green fluorescent cells after 24 hours. FIG. 3C depicts 3'RACE products amplified from cells expressing dPspCas13b-NUDT21 fusion protein and non-targeting control or intronic targeting crRNA. FIG. 3D and FIG. 3E depict sequences of the five most proximal 3'RACE products relative to the crRNA target site. Please see Example 3 for complete list of 3'RACE sequences. Green underlined and lowercase nucleotides highlight 3' non-templated nucleotide addition. FIG. 3F depicts nucleotide frequencies at Postscriptr-mediated cleavage and polyadenylation sites.

FIG. 4, comprising FIG. 4A through FIG. 4I, depicts Postscriptr-mediated alternative cleavage and polyadenylation of human SREBP1 in HEK293T cells. FIG. 4A depicts a diagram of the SREBP1 maturation pathway. FIG. 4B depicts the human SREBP1 locus contains an intronic PAS between exon 7 and exon 8, which results in translation of an SREBP1Δ isoform which terminates translation adjacent to the normal S2P cleavage site. FIG. 4C depicts the SREP1 sequence and SREBP1Δ isoform sequence. FIG. 4D depicts a diagram of the Postscriptr-mediated targeting strategy and sequence of the recovered Postscriptr-induced cleaved transcript. FIG. 4E depicts a diagram of the Postscriptr-mediated targeting strategy and sequence of the recovered Postscriptr-induced polyadenylated transcript. FIG. 4F depicts the predicted translational stop. FIG. 4G depicts quantitative realtime-PCR (qRT-PCR) gene expression analysis of SREBP1 transcript levels upstream of the crRNA target sequence in HEK293T cells targeted with a non-targeted or SREBP1-targeted crRNA. FIG. 4H depicts quantitative realtime-PCR (qRT-PCR) gene expression analysis of SREBP1 transcript levels spanning the crRNA target sequence in HEK293T cells targeted with a non-targeted or SREBP1-targeted crRNA. FIG. 4I depicts quantitative realtime-PCR (qRT-PCR) gene expression analysis of transcript levels of the LDLR gene in HEK293T cells targeted with a non-targeted or SREBP1-targeted crRNA.

FIG. 6A depicts a diagram of the sfGFPapa reporter and predicted transcription and processing steps resulting from treatment with the splicing inhibitor isoginkgetin. FIG. 6B depicts COS7 cells transiently transfected with the sfGFPapa reporter for 24 hours were treated with DMSO or isoginkgetin for an additional 24 hours. Cells treated with isoginkgetin resulted in detectable green fluorescence. Scale bars in B=100 μm.

FIG. 7A and FIG. 7B, depicts experimental results demonstrating that the dPspCas13b fusions to CPSP30 or WDR33 were not sufficient to promote cleavage and polyadenylation of the sfGFPapa reporter mRNA. FIG. 7A depicts Postscriptr targeting of the sfGFPapa reporter using the dPspCas13b-CPSF30 fusion protein using an intronic-targeting crRNA did not result in detectable green fluorescence relative to a control crRNA. FIG. 7B depicts Postscriptr targeting of the sfGFPapa reporter using the dPspCas13b-WDR33 fusion protein using an intronic-targeting crRNA did not result in detectable green fluorescence relative to a control crRNA. Scale bars in =100 μm

FIG. 9A through FIG. 9B, depicts experimental results demonstrating Cas13b crRNA Sequence Modifications Enhance Postscriptr Activity. FIG. 9A depicts a schematic demonstrating CRISPR-Cas13 guide-RNAs are typically expressed in mammalian cells from Polymerase III (Pol III) promoters, which are terminated by poly(T) sequences. Recently it has been shown that a stretch of only 4 T's can result in 75% decrease in full length expression of a small RNA by the U6 promoter. FIG. 9B depicts a schematic demonstrating multiple Cas13b crRNAs contain Direct Repeat (DR) sequences. FIG. 9C depicts a schematic demonstrating that the DR sequences contain a stretch of 4 or 5 T's. FIG. 9D depicts crystal structures demonstrating that these nucleotides fall within the loop region, and some positions do not make direct molecular interactions. Yellow highlight in 9B and Yellow arrowhead in 9D. FIG. 9E depicts a schematic demonstrating generation conservative mutations (T to C) in the DR of PspCas13b crRNA.

FIG. 10 depicts a sequence alignment of NUDT21 proteins from human, fly and worm.

FIG. 13, comprising FIG. 13A through FIG. 13D, depicts therapeutic correction of DM1 with targeted alternative cleavage and polyadenylation of human DMPK transcripts. Alternative polyadenylation (APA) of RNA is an important regulatory mechanism controlling gene expression during development and disease. Recent deep sequencing has revealed that some DMPK transcripts can be alternatively cleaved and polyadenylated at a position upstream of the site of CUG expansion, suggesting that manipulating APA could be a useful approach for both preserving DMPK expression while preventing transcription of downstream toxic repeat RNAs. FIG. 13A depicts a schematic of Postscriptr. FIG. 13B depicts a schematic demonstrating that Postscriptr combines the programmable RNA-targeting capability of CRISPR-Cas13 with a mammalian polyadenylation factor to induce site-specific cleavage and polyadenylation of RNA transcripts. FIG. 13C depicts experimental results demonstrating Postscriptr can robustly induce alternative cleavage and polyadenylation of endogenous human DMPK transcripts upstream of the site of CUG repeat expansion. FIG. 13D depicts experimental results demonstrating targeted alternative polyadenylation of mutant DMPK transcripts by Postscriptr can both rescue DMPK expression and prevent the transcription of downstream toxic CUG repeat RNA.

FIG. 14, comprising FIG. 14A through FIG. 14C, depicts the molecular origins of DM1. FIG. 14A depicts a schematic demonstrating that myotonic dystrophy Type 1 (DM1) results from a microsatellite CTG repeat expansion in the 3' UTR of the human DMPK gene. FIG. 14B depicts the DMPK $CUG^{exp}$ RNA forms a stable hairpin, which is retained in nuclear foci, thus preventing normal DMPK gene expression and sequesters the MBNL family of RNA binding proteins. FIG. 14C depicts a schematic demonstrating that the nuclear foci result in widespread defects in alternative splicing and polyadenylation.

FIG. 15A through FIG. 15C, depicts schematics demonstrating alternative polyadenylation. FIG. 15A depicts a schematic demonstrating deep sequencing of the human transcriptome has revealed that more than half of all genes undergo alternative cleavage and polyadenylation at intronic, proximal, or distal polyadenylation signals (PAS).

FIG. 15B depicts a schematic demonstrating a supercomplex of ~20 proteins coordinates 3' end processing and transcriptional termination. RNA binding components of the CFIm and CPSF sub complex recognize RNA motifs in pre-RNA transcripts which specify the site of cleavage and polyadenylation. FIG. 15C depicts a schematic demonstrating the novel RNA editing technology described herein, named Postscriptr, which is sufficient to induce targeted cleavage and polyadenylation using CRISPR-Cas13.

FIG. 16, comprising FIG. 16A and FIG. 16B, depicts experimental results demonstrating nuclear localization of dCas13 fusion proteins require a unique NLS. FIG. 16A depicts a schematic of the vector encoding fusions between catalytically dead PspCas13b and NUDT21. FIG. 16B depicts experimental results demonstrating mammalian cleavage and polyadenylation occurs in the nucleus. A non-classical nuclear localization signal (NLS) from the yeast retrotransposon Ty1 is essential for nuclear localization of the dPspCas13b-NUDT21 fusion protein.

FIG. 17A and FIG. 17B, depicts experimental results demonstrating targeted cleavage and polyadenylation of RNA. FIG. 17A depicts a schematic showing the Postscriptr targeting strategy to induce alternative cleavage and polyadenylation of the sfGFPapa reporter construct. A crRNA was designed to target an intronic sequence downstream of the coding sequence of the 11th beta strand of sfGFP. FIG. 17B depicts expression of the dPspCas13b-NUDT21 fusion protein and intronic targeting crRNA resulted in green fluorescent cells after 24 hours.

FIG. 18A and FIG. 18B, depicts experimental results demonstrating Postscriptr editing of endogenous human DMPK transcripts. FIG. 18A depicts the design of guide-RNAs targeting the DMPK 3' UTR at a position downstream of the DMPK stop codon and upstream of the CUGexp site. FIG. 18B depicts experimental results demonstrating Postscriptr editing of DMPK transcripts in HEK293T cells revealing that Postscriptr promoted the utilization of the proximal PAS and decreased expression of the distal PAS with full length DMPK protein coding sequences, indicated by retention of the distal exons. Thus, this strategy could provide a mechanism to promote DMPK expression and prevent downstream expression of CUGexp RNA.

FIG. 19A through FIG. 19D, depicts experimental results demonstrating targeting CUG repeat RNA foci with dCas13. FIG. 19A depicts a schematic of a fusion of eGFP to dPspCas13b to visualize dCas13 subcellular localization. This construct is named HiLightr Green. FIG. 19B depicts DT960, an expression plasmid which contains 960 CUG repeats in the context of human DMPK exons 11-15, which was used to induce nuclear foci. FIG. 19C depicts experimental a schematic of CAGx9 guide-RNA. FIG. 19D depicts experimental results demonstrating HiLightr green co-localized with mCherry-MBNL1 to RNA foci when targeted with an antisense CAGx9 guide-RNA but remained unlocalized when using a non-targeting guide-RNA.

FIG. 20, comprising FIG. 20A and FIG. 20B, depicts experimental results demonstrating CUGexp RNAs prevent mRNA expression. FIG. 20A depicts luciferase expression vectors containing the human DMPK 3' UTR with either 12 CUG repeats (pGL3P-DT12a) or 960 CUG repeats (pGL3P-DT960). FIG. 20B depicts experimental results demonstrating the presence of the 960 CUG repeats resulted in a 90% reduction in luciferase activity when expressed in COST cells.

FIG. 21, comprising FIG. 21A through FIG. 21D, depicts the inducible DM1 mouse model. An inducible humanized mouse model of DM1 is used which expresses a 960 CUG expansion RNA in the context of human DMPK exons 11-15. FIG. 21A depicts a schematic demonstrating crossing a transgene to a skeletal muscle specific rtTA transgene. FIG. 21B depicts a schematic demonstrating that transgene expression can be induced by doxycycline (dox). FIG. 21C depicts the Postscriptr editing components encoded in a lentiviral vector. FIG. 21D depicts that the lentiviral vector is used to generate lentiviral particles which are delivered during postnatal development concomitant with dox. Postscriptr editing of the CUG encoded transcripts are used to model the effectiveness of Postscriptr mitigation of DM1.

FIG. 22A through FIG. 22D, depicts experimental results demonstrating the development of a robust nuclear localized CRISPR-Cas13 fusion protein for the visualization of toxic RNA foci. FIG. 22A depicts the design of a catalytically dead PspCas13b (dPspCas13b) encoding an N-terminal 3×FLAG and Ty1 NLS and C-terminal eGFP. F—3×FLAG epitope; NLS—Ty1 nuclear localization sequence; pA—SV40 polyadenylation sequence. FIG. 22B depicts a diagram depicting the components of the DT960 vector, which encodes a C-terminal genomic fragment of human DMPK (exons 11-15) with 960 CTG repeat expansion. FIG. 22C depicts the design of the CAGx9 crRNA and its predicted targeting with $CUG^{exp}$ RNA. FIG. 22D depicts representative images showing the cellular localization of hilightR green targeted with either a non-targeting or CAGx9 crRNA in COS7 cells expressing $CUG^{exp}$ RNA. Scale bars, 10 μm.

FIG. 23, comprising FIG. 23A and FIG. 23B, depicts experimental results demonstrating co-localization of hilightR green with $CUG^{exp}$ foci and MBNL1. FIG. 23A depicts immunohistochemistry using an anti-FLAG antibody was used to detect hilightR red, which co-localized with $CUG^{exp}$ RNA detected using FISH, when targeted with the CAGx9 crRNA. FIG. 23B depicts HilightR green co-localized with mCherry-MBNL1 in COS7 cells expressing $CUG^{exp}$ RNA foci when targeted with the CAGx9 crRNA, but not with a non-targeting crRNA. Scale bars, 10 μm.

FIG. 24A and FIG. 24B, depicts experimental results demonstrating degradation of toxic RNA foci by CRISPR-Cas13. FIG. 24A depicts co-expression of active PspCas13b encoding a Ty1 NLS (eraseR) significantly decreased the number of RNA foci in cells expressing $CUG^{exp}$ RNA, when targeted with CAG crRNAs designed with target sequences in all three frames, detected by mCherry-MBNL1. FIG. 24B depicts representative micrographs of cells targeted by eraseR showing foci detected by mCherry-MBNL1, which are significantly decreased in number and appear fainter. Scale bars, 10 μm. =p-value <0.01, *=p-value <0.001, ****=p-value <0.0001.

FIG. 25A through FIG. 25C, depicts experimental results demonstrating detection of induced $CUG^{exp}$ RNA foci in COS7 cells. FIG. 25A depicts COS7 cells expressing 960 copies of CUG repeats induced RNA foci as detected using FISH with a CAG repeat antisense probe. AF488—Alexa Fluor 488. FIG. 25B depicts expression of $CUG^{exp}$ RNA induces the localization of MBNL1 to foci, as detected using an mCherry-MBNL1 fusion protein. FIG. 25C depicts localization of dPspCas13b-mCherry (hilightR red) guided by either a non-targeting or CAGx9 crRNA in COS7 cells expressing $CUG^{exp}$ RNA. Scale bars, 10 μm.

FIG. 28, comprising FIG. 28A through FIG. 28D, depicts a diagram demonstrating therapeutic modulation of DM1 by CRISPR-Cas13. FIG. 28A depicts that myotonic Dystrophy Type1 is caused by the expansion and expression of a CUG repeat in the 3' noncoding UTR of the human DMPK gene. This CUG expansion forms stable hairpin structures, which bind and sequester the MBNL family of RNA binding proteins, resulting in widespread defects in alternative splicing and polyadenylation. FIG. 28B depicts CUG repeats are resistant to cleavage induced by Antisense Oligonucleotides (ASO), however, ASOs have been successfully used to block binding of MBNL1 proteins. However, many challenges remain to deliver therapeutically effective levels of ASOs to human tissues. FIG. 28C depicts specific binding of dCas13 guide by a crRNA, or potentially the crRNA alone, can serve to block MBNL proteins and rescue splicing and polyadenylation defects, or when combined with a fluorescent protein, highlight CUG repeat RNA foci. FIG. 28D depicts catalytically active Cas13 can be used to cleave and degrade CUG repeat RNA to prevent MBNL sequestration, as well as other potential CUG repeat-induced pathologies, such as RAN dependent translation of toxic peptides.

FIG. 30, comprising FIG. 30A through FIG. 30E, depicts experimental results demonstrating therapeutic rescue of heart function in a mouse model of DM1. FIG. 30A depicts the generation of CUG960 cardiac DM1 mouse model. FIG. 30B depicts the generation of CUG960 cardiac DM1 mouse model. FIG. 30C depicts a diagram of eraseR AAV construct. FIG. 30D depicts experimental results demonstrating heart-specific gene delivery and expression using AAV9. FIG. 30E depicts delivery of eraseR AAV targeting CUGexp RNA reversal of the cellular and electrical abnormalities in DM1 hearts.

FIG. 31, comprising FIG. 31A through FIG. 31D, depicts experimental results demonstrating activation of Calcineurin signaling using Postscriptr. FIG. 31A depicts a schematic showing calcineurin is a Ca2+/Calmodulin activated protein phosphatase which is auto-inhibited by a C-terminal auto-inhibitory domain in the absence of calcium signaling. FIG. 31A depicts a schematic showing upon activation, Calcineurin dephosphorylates NFAT transcription factors, which allows for nuclear entry and activation of NFAT target genes. FIG. 31A depicts a schematic showing the design of guide-RNAs to induce the alternative cleavage and polyadenylation of Calcineurin (PPP3CB) gene to allow for the expression of an N-terminal fragment of Calcineurin catalytic domain which lacks the C-terminal auto-inhibitory domain. FIG. 31A depicts Postscriptr expression in mouse fibroblasts targeting the PPP3CB gene resulted in nuclear localization of an NFAT-GFP reporter gene, which is normally retained in the cytoplasm and was not affected by a non-targeting guide-RNA.

FIG. 32, comprising FIG. 32A through FIG. 32D, depicts strategies to enhance RNA visualization and fusion protein localization with dCas13. FIG. 32A depicts a schematic depicting fusion of single Green Fluorescent Protein (GFP) to catalytically inactive Cas13 (dCas13), which can be used for specific visualization of nuclear RNA repeat foci in cells. FIG. 32A depicts a schematic depicting fluorescent complementation inherent in fluorescent proteins (for example GFP, superfolder GFP, or superfolder Cherry) could be harnessed to reconstitute fluorescent proteins to dCas13 (for example, the complement pair sfGFP 1-10 and sfGFP11). FIG. 32C depicts a schematic depicting tandem assembly of small non-fluorescent components can be used to reconstitute a large tandem array of fluorescent proteins to dCas13, which has the potential to increase the signal to noise ratio of dCas13 targeted RNAs. FIG. 32A depicts a schematic depicting this approach could be similarly useful for targeting fusion proteins (Protein 'X') when co-expressed as a fusion to a complementary fluorescent fusion protein (for example, sfGFP1-10).

FIG. 33, comprising FIG. 33A through FIG. 33C, depicts the structure-function analysis of Postscriptr RNA editing. FIG. 33A depicts structural modeling of the dCas13b-NUDT21 fusion protein and crRNA, using high resolution crystal structures of Cas13b (6DTD) and NUDT21 (3MDG). FIG. 33B depicts results demonstrating NUDT21 forms a natural homodimer, which due to the close proximity of N and C-termini, can be expressed as a tandem dimer fused to dCas13b (dCas13b-tdNUDT21). FIG. 33C depicts a model depicting the structural orientation of the dCas13b-NUDT21 fusion protein hybridized anti-sense to a Target RNA. The orientation of NUDT21 is predicted to occur 3' to the crRNA target sequence on the Target RNA, which is consistent with the observed location of Postscriptr-induced RNA cleavage and polyadenylation.

DETAILED DESCRIPTION

Figure 5:
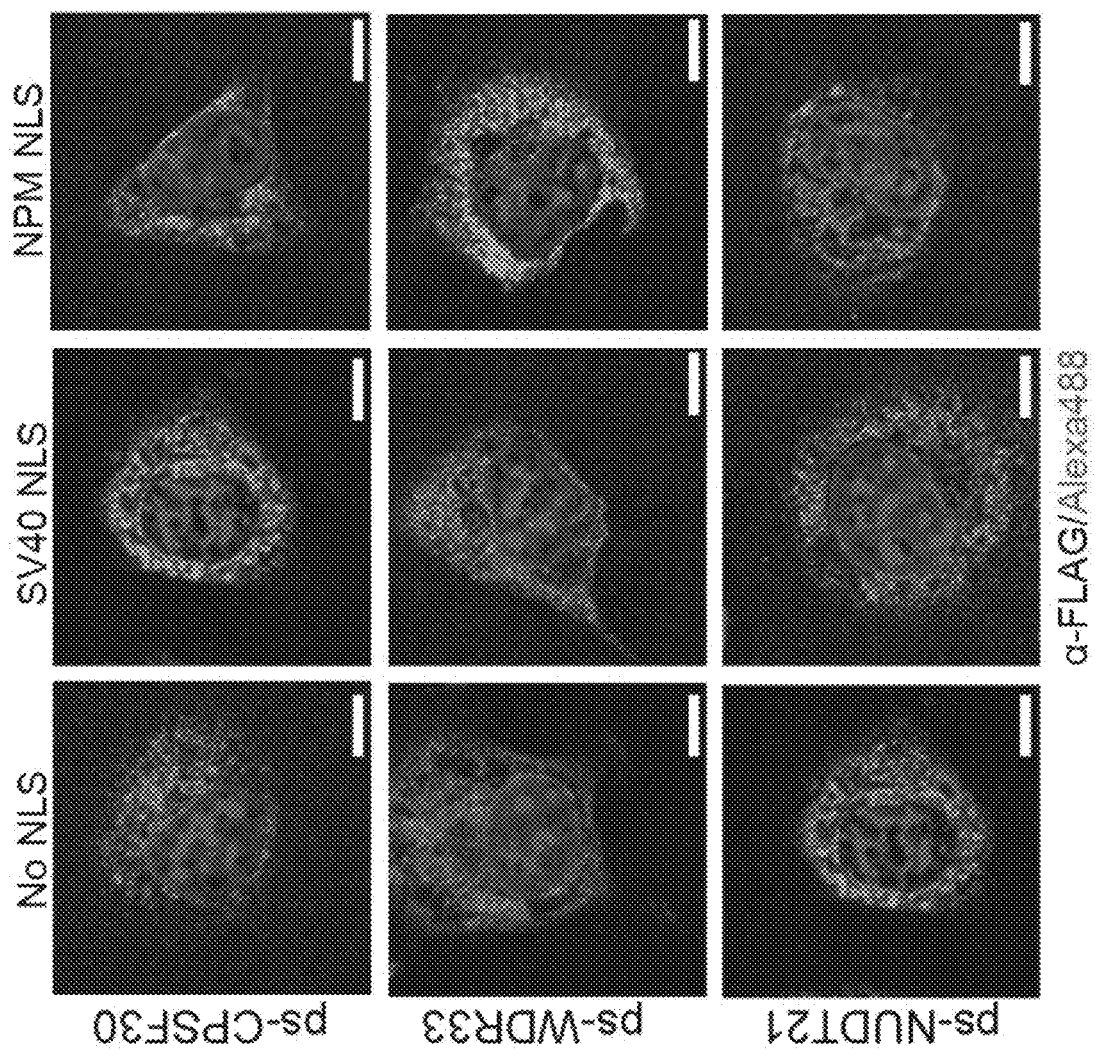
FIG. 5 depicts experimental results demonstrating that classic mammalian nuclear localization signals were insufficient to promote nuclear localization of dPspCas13b fusion proteins. Immunohistochemistry using a primary anti-FLAG antibody and secondary Alexa488 conjugated secondary antibody were used to detecting the localization of dPspCas13b fusion proteins expressed in mammalian COS7 cells. Fusions proteins contained either no NLS, a classic SV40 NLS or the bipartite NLS from Nucleoplasmin (NPM). Scale bars in =10 μm FIG. 6, comprising

In one aspect, the invention is based on the development of novel fusion proteins which allows for targeted RNA cleavage and polyadenylation of RNA transcripts by CRISPR-Cas. This fusion protein, termed Postscriptr herein, comprises a Cas protein, a nuclear localization signal (NLS) and a cleavage and/or polyadenylation protein, such as NUDT21. Mutations in Cas13 generates a catytically dead enzyme (dCas) but retains RNA binding affinity. Thus, a fusion of dCas13 and a cleavage and/or polyadenylation protein allows for targeted cleavage and/or polyadenylation protein. Poscripter allows for non-genomic manipulation of gene expression, useful for both basic research and therapeutic applications.

Thus, in one embodiment, the invention provides compositions and methods for modulating the cleavage, polyadenylation or both of an RNA transcript in a subject. In one embodiment, the invention provides a fusion protein comprising a CRISPR-Associated (Cas) protein, a cleavage and/or polyadenylation protein. In one embodiment, the fusion protein further comprises a nuclear localization signal. In one embodiment, the fusion protein further comprises a linker. In one embodiment, the linker links the Cas protein and cleavage and/or polyadenylation protein. In one embodiment, the fusion protein comprises a tag.

In one embodiment, the fusion protein comprises an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 696-698.

In one embodiment, the invention provides a nucleic acid encoding a fusion protein, wherein the fusion protein comprises a Cas protein and a cleavage and/or polyadenylation protein. In one embodiment, the fusion protein further comprises a nuclear localization signal. In one embodiment, the fusion protein further comprises a linker. In one embodiment, the linker links the Cas protein and cleavage and/or polyadenylation protein. In one embodiment, the fusion protein comprises a tag.

In one embodiment, nucleic acid molecule comprises a nucleic acid sequence least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 725-727.

The invention is also based on the surprising development of novel fusion proteins which allows for targeted nuclear RNA cleavage and degradation. This fusion protein, termed EraseR herein, comprises a Cas protein and a nuclear localization signal (NLS). CRISPR-Cas13 systems bind only to RNA and function as specific endoribonucleases to cleave target RNAs, bypassing the risk of germline editing that is associated with DNA-binding CRISPR-Cas endonucleases. However, due to their large size and lack of intrinsic localization signals, Cas13 fusion proteins are inefficiently localized to the mammalian nucleus. The EraseR fusion protein is effectively and efficiently delivered to the nucleus allowing for targeted nuclear RNA cleavage and degradation. Thus, EraseR allows for non-genomic manipulation of gene expression, useful for both basic research and therapeutic applications.

Thus, in one embodiment, the invention provides compositions and methods for decreasing the number of a nuclear RNA in a subject. In one embodiment, the invention provides a fusion protein comprising a Cas protein and an NLS.

In one embodiment, the fusion protein comprises an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NOs: 702.

In one embodiment, the invention provides a nucleic acid encoding a fusion protein, wherein the fusion protein comprises a Cas protein and an NLS.

In one embodiment, nucleic acid molecule comprises a nucleic acid sequence least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 723.

The invention is also based on the surprising development of novel fusion proteins which allows for specific visualization of nuclear RNA. This fusion protein, termed HilightR herein, comprises a Cas protein and a fluorescent protein. Mutations in Cas13 generates a catytically dead enzyme (dCas) but retains RNA binding affinity. Thus, a fusion of dCas13 and a fluorescent protein allows for targeted visualization of RNA. Accordingly, HilightR allows for visualization of RNA, including nuclear RNA.

CRISPR-Cas13 systems bind only to RNA and function as specific endoribonucleases to cleave target RNAs, bypassing the risk of germline editing that is associated with DNA-binding CRISPR-Cas endonucleases. However, due to their large size and lack of intrinsic localization signals, Cas13 fusion proteins are inefficiently localized to the mammalian nucleus. The EraseR fusion protein is effectively and efficiently delivered to the nucleus allowing for targeted nuclear RNA cleavage and degradation. Thus, EraseR allows for non-genomic manipulation of gene expression, useful for both basic research and therapeutic applications.

In one embodiment, the invention provides a nucleic acid encoding a fusion protein, wherein the fusion protein comprises a Cas protein and a fluorescent protein. In one embodiment, the fusion protein further comprises a nuclear localization signal. In one embodiment, the fusion protein further comprises a linker. In one embodiment, the linker links the Cas protein and fluorescent protein. In one embodiment, the fusion protein comprises a tag.

In one embodiment, the fusion protein comprises an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 699-701.

In one embodiment, the invention provides a nucleic acid encoding a fusion protein, wherein the fusion protein comprises a Cas protein and a fluorescent protein. In one embodiment, the fusion protein further comprises a nuclear localization signal. In one embodiment, the fusion protein further comprises a linker. In one embodiment, the linker links the Cas protein and fluorescent protein. In one embodiment, the fusion protein comprises a tag.

In one embodiment, nucleic acid molecule comprises a nucleic acid sequence least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 728-730.

Definitions

Unless defined otherwise, all technical and scientific terms used herein have the same meaning as commonly understood by one of ordinary skill in the art to which this invention belongs.

Generally, the nomenclature used herein and the laboratory procedures in cell culture, molecular genetics, organic chemistry, and nucleic acid chemistry and hybridization are those well-known and commonly employed in the art.

Standard techniques are used for nucleic acid and peptide synthesis. The techniques and procedures are generally performed according to conventional methods in the art and various general references (e.g., Sambrook and Russell, 2012, Molecular Cloning, A Laboratory Approach, Cold Spring Harbor Press, Cold Spring Harbor, NY, and Ausubel et al., 2012, Current Protocols in Molecular Biology, John Wiley & Sons, NY), which are provided throughout this document.

The nomenclature used herein and the laboratory procedures used in analytical chemistry and organic syntheses described below are those well-known and commonly employed in the art. Standard techniques or modifications thereof are used for chemical syntheses and chemical analyses.

The term "a," "an," "the" and similar terms used in the context of the present invention (especially in the context of the claims) are to be construed to cover both the singular and plural unless otherwise indicated herein or clearly contradicted by the context.

"About" as used herein when referring to a measurable value such as an amount, a temporal duration, and the like, is meant to encompass variations of ±20%, or ±10%, or ±5%, or ±1%, or ±0.1% from the specified value, as such variations are appropriate to perform the disclosed methods.

"Antisense" refers particularly to the nucleic acid sequence of the non-coding strand of a double stranded DNA molecule encoding a protein, or to a sequence which is substantially homologous to the non-coding strand. As defined herein, an antisense sequence is complementary to the sequence of a double stranded DNA molecule encoding a protein. It is not necessary that the antisense sequence be complementary solely to the coding portion of the coding strand of the DNA molecule. The antisense sequence may be complementary to regulatory sequences specified on the coding strand of a DNA molecule encoding a protein, which regulatory sequences control expression of the coding sequences.

A "disease" is a state of health of an animal wherein the animal cannot maintain homeostasis, and wherein if the disease is not ameliorated then the animal's health continues to deteriorate.

In contrast, a "disorder" in an animal is a state of health in which the animal is able to maintain homeostasis, but in which the animal's state of health is less favorable than it would be in the absence of the disorder. Left untreated, a disorder does not necessarily cause a further decrease in the animal's state of health.

A disease or disorder is "alleviated" if the severity of a sign or symptom of the disease or disorder, the frequency with which such a sign or symptom is experienced by a patient, or both, is reduced.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

The terms "patient," "subject," "individual," and the like are used interchangeably herein, and refer to any animal or cell whether in vitro or in vivo, amenable to the methods described herein. In one embodiment, the subjects include vertebrates and invertebrates. Invertebrates include, but are not limited to, *Drosophila melanogaster* and *Caenorhabditis elegans*. Vertebrates include, but are not limited to, primates, rodents, domestic animals or game animals. Primates include, but are not limited to, chimpanzees, cynomologous monkeys, spider monkeys, and macaques (e.g., Rhesus). Rodents include, but are not limited to, mice, rats, woodchucks, ferrets, rabbits and hamsters. Domestic and game animals include, but are not limited to, cows, horses, pigs, deer, bison, buffalo, feline species (e.g., domestic cat), canine species (e.g., dog, fox, wolf), avian species (e.g., chicken, emu, ostrich), and fish (e.g., zebrafish, trout, catfish and salmon). In some embodiments, the subject is a mammal, e.g., a primate, e.g., a human. In certain non-limiting embodiments, the patient, subject or individual is a human.

By the term "specifically binds," as used herein with respect to an antibody, is meant an antibody which recognizes a specific antigen, but does not substantially recognize or bind other molecules in a sample. For example, an antibody that specifically binds to an antigen from one species may also bind to that antigen from one or more species. But, such cross-species reactivity does not itself alter the classification of an antibody as specific. In another example, an antibody that specifically binds to an antigen may also bind to different allelic forms of the antigen. However, such cross reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds to a specific protein structure rather than to proteins generally. If an antibody is specific for epitope "A", the presence of a molecule containing epitope A (or free, unlabeled A), in a reaction containing labeled "A" and the antibody, will reduce the amount of labeled A bound to the antibody.

A "coding region" of a gene consists of the nucleotide residues of the coding strand of the gene and the nucleotides of the non-coding strand of the gene which are homologous with or complementary to, respectively, the coding region of an mRNA molecule which is produced by transcription of the gene.

A "coding region" of a mRNA molecule also consists of the nucleotide residues of the mRNA molecule which are matched with an anti-codon region of a transfer RNA molecule during translation of the mRNA molecule or which encode a stop codon. The coding region may thus include nucleotide residues comprising codons for amino acid residues which are not present in the mature protein encoded by the mRNA molecule (e.g., amino acid residues in a protein export signal sequence).

"Complementary" as used herein to refer to a nucleic acid, refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. In one embodiment, the first region comprises a first portion and the second region comprises a second portion, whereby, when the first and second portions are arranged in an antiparallel fashion, at least about 50%, at least about 75%, at least about 90%, or at least about 95% of the nucleotide residues of the first portion are capable of base pairing with nucleotide residues in the second portion. In one embodiment, all nucleotide residues of the first portion are capable of base pairing with nucleotide residues in the second portion.

The term "DNA" as used herein is defined as deoxyribonucleic acid.

The term "expression" as used herein is defined as the transcription and/or translation of a particular nucleotide sequence driven by its promoter.

The term "expression vector" as used herein refers to a vector containing a nucleic acid sequence coding for at least part of a gene product capable of being transcribed. In some cases, RNA molecules are then translated into a protein, polypeptide, or peptide. In other cases, these sequences are not translated, for example, in the production of antisense molecules, siRNA, ribozymes, and the like. Expression vectors can contain a variety of control sequences, which refer to nucleic acid sequences necessary for the transcription and possibly translation of an operatively linked coding sequence in a particular host organism. In addition to control sequences that govern transcription and translation, vectors and expression vectors may contain nucleic acid sequences that serve other functions as well.

As used herein the term "wild type" is a term of the art understood by skilled persons and means the typical form of an organism, strain, gene or characteristic as it occurs in nature as distinguished from mutant or variant forms.

The term "homology" refers to a degree of complementarity. There may be partial homology or complete homology (i.e., identity). Homology is often measured using sequence analysis software (e.g., Sequence Analysis Software Package of the Genetics Computer Group. University of Wisconsin Biotechnology Center. 1710 University Avenue. Madison, Wis. 53705). Such software matches similar sequences by assigning degrees of homology to various substitutions, deletions, insertions, and other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine.

"Isolated" means altered or removed from the natural state. For example, a nucleic acid or a peptide naturally present in its normal context in a living animal is not "isolated," but the same nucleic acid or peptide partially or completely separated from the coexisting materials of its natural context is "isolated." An isolated nucleic acid or protein can exist in substantially purified form, or can exist in a non-native environment such as, for example, a host cell.

The term "isolated" when used in relation to a nucleic acid, as in "isolated oligonucleotide" or "isolated polynucleotide" refers to a nucleic acid sequence that is identified and separated from at least one contaminant with which it is ordinarily associated in its source. Thus, an isolated nucleic acid is present in a form or setting that is different from that in which it is found in nature. In contrast, non-isolated nucleic acids (e.g., DNA and RNA) are found in the state they exist in nature. For example, a given DNA sequence (e.g., a gene) is found on the host cell chromosome in proximity to neighboring genes; RNA sequences (e.g., a specific mRNA sequence encoding a specific protein), are found in the cell as a mixture with numerous other mRNAs that encode a multitude of proteins. However, isolated nucleic acid includes, by way of example, such nucleic acid in cells ordinarily expressing that nucleic acid where the nucleic acid is in a chromosomal location different from that of natural cells, or is otherwise flanked by a different nucleic acid sequence than that found in nature. The isolated nucleic acid or oligonucleotide may be present in single-stranded or double-stranded form. When an isolated nucleic acid or oligonucleotide is to be utilized to express a protein, the oligonucleotide contains at a minimum, the sense or coding strand (i.e., the oligonucleotide may be single-stranded), but may contain both the sense and anti-sense strands (i.e., the oligonucleotide may be double-stranded).

The term "isolated" when used in relation to a polypeptide, as in "isolated protein" or "isolated polypeptide" refers to a polypeptide that is identified and separated from at least one contaminant with which it is ordinarily associated in its source. Thus, an isolated polypeptide is present in a form or setting that is different from that in which it is found in nature. In contrast, non-isolated polypeptides (e.g., proteins and enzymes) are found in the state they exist in nature.

By "nucleic acid" is meant any nucleic acid, whether composed of deoxyribonucleosides or ribonucleosides, and whether composed of phosphodiester linkages or modified linkages such as phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages. The term nucleic acid also specifically includes nucleic acids composed of bases other than the five biologically occurring bases (adenine, guanine, thymine, cytosine and uracil). The term "nucleic acid" typically refers to large polynucleotides.

Conventional notation is used herein to describe polynucleotide sequences: the left-hand end of a single-stranded polynucleotide sequence is the 5'-end; the left-hand direction of a double-stranded polynucleotide sequence is referred to as the 5'-direction.

The direction of 5' to 3' addition of nucleotides to nascent RNA transcripts is referred to as the transcription direction. The DNA strand having the same sequence as an mRNA is referred to as the "coding strand"; sequences on the DNA strand which are located 5' to a reference point on the DNA are referred to as "upstream sequences"; sequences on the DNA strand which are 3' to a reference point on the DNA are referred to as "downstream sequences."

By "expression cassette" is meant a nucleic acid molecule comprising a coding sequence operably linked to promoter/regulatory sequences necessary for transcription and, optionally, translation of the coding sequence.

The term "operably linked" as used herein refer to the linkage of nucleic acid sequences in such a manner that a nucleic acid molecule capable of directing the transcription of a given gene and/or the synthesis of a desired protein molecule is produced. The term also refers to the linkage of sequences encoding amino acids in such a manner that a functional (e.g., enzymatically active, capable of binding to a binding partner, capable of inhibiting, etc.) protein or polypeptide is produced.

As used herein, the term "promoter/regulatory sequence" means a nucleic acid sequence which is required for expression of a gene product operably linked to the promoter/regulator sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a n inducible manner.

As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part 1, Second Chapter "Overview of principles of hybridization and the strategy of nucleic acid probe assay", Elsevier, N.Y.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence.

An "inducible" promoter is a nucleotide sequence which, when operably linked with a polynucleotide which encodes or specifies a gene product, causes the gene product to be produced substantially only when an inducer which corresponds to the promoter is present.

A "constitutive" promoter is a nucleotide sequence which, when operably linked with a polynucleotide which encodes or specifies a gene product, causes the gene product to be produced in a cell under most or all physiological conditions of the cell.

The term "polynucleotide" as used herein is defined as a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomeric "nucleotides." The monomeric nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and PCR, and the like, and by synthetic means.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

The term "RNA" as used herein is defined as ribonucleic acid.

"Recombinant polynucleotide" refers to a polynucleotide having sequences that are not naturally joined together. An amplified or assembled recombinant polynucleotide may be included in a suitable vector, and the vector can be used to transform a suitable host cell.

A recombinant polynucleotide may serve a non-coding function (e.g., promoter, origin of replication, ribosome-binding site, etc.) as well.

The term "recombinant polypeptide" as used herein is defined as a polypeptide produced by using recombinant DNA methods.

"Variant" as the term is used herein, is a nucleic acid sequence or a peptide sequence that differs in sequence from a reference nucleic acid sequence or peptide sequence respectively, but retains essential biological properties of the reference molecule. Changes in the sequence of a nucleic acid variant may not alter the amino acid sequence of a peptide encoded by the reference nucleic acid, or may result in amino acid substitutions, additions, deletions, fusions and truncations. Changes in the sequence of peptide variants are typically limited or conservative, so that the sequences of the reference peptide and the variant are closely similar overall and, in many regions, identical. A variant and reference peptide can differ in amino acid sequence by one or more substitutions, additions, deletions in any combination. A variant of a nucleic acid or peptide can be a naturally occurring such as an allelic variant, or can be a variant that is not known to occur naturally. Non-naturally occurring variants of nucleic acids and peptides may be made by mutagenesis techniques or by direct synthesis.

A "vector" is a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. The term should also be construed to include non-plasmid and non-viral compounds which facilitate transfer of nucleic acid into cells, such as, for example, polylysine compounds, liposomes, and the like. Examples of viral vectors include, but are not limited to, adenoviral vectors, adeno-associated virus vectors, retroviral vectors, and the like.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

Fusion Proteins

In one aspect, the present invention is based on the development of novel fusions of editing proteins which are effectively delivered to the nucleus. In one embodiment, the fusion protein is effectively delivered to the nucleus and is capable of cleaving nuclear RNA. In one embodiment, the fusion protein is effectively delivered to the nucleus and is capable of visualizing nuclear RNA. In one embodiment, the fusion protein is effectively delivered to the nucleus and is capable of modulating the cleavage and/or polyadenylation of nuclear RNA.

EraseR

In one aspect, the present invention is based on the development of novel fusions of editing proteins which are effectively delivered to the nucleus. In one aspect, the invention provides fusion proteins comprising an editing protein having a first amino acid sequence and a nuclear localization signal (NLS) having a second amino acid sequence.

In one embodiment, the editing protein includes, but is not limited to, a CRISPR-associated (Cas) protein, a zinc finger nuclease (ZFN) protein, and a protein having a DNA or RNA binding domain.

Non-limiting examples of Cas proteins include Cas1, Cas1B, Cas2, Cas3, Cas4, Cas5, Cash, Cas7, Cas8, Cas9, Cas10, Csy1, Csy2, Csy3, Cse1, Cse2, Csc1, Csc2, Csa5, Csn2. Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, SpCas9, StCas9, NmCas9, SaCas9, CjCas9, CjCas9, AsCpf1, LbCpf1, FnCpf1, VRER SpCas9, VQR SpCas9, xCas9 3.7, homologs thereof, orthologs thereof, or modified versions thereof. In some embodiments, the Cas protein has DNA or RNA cleavage activity. In some embodiments, the Cas protein directs cleavage of one or both strands of a nucleic acid molecule at the location of a target sequence, such as within the target sequence and/or within the complement of the target sequence. In some embodiments, the Cas protein directs cleavage of one or both strands within about 1, 2, 3, 4, 5, 6, 7, 8, 9, 10, 15, 20, 25, 50, 100, 200, 500, or more base pairs from the first or last nucleotide of a target sequence. In one embodiment, the Cas protein is Cas9, Cas13, or Cpf1. In one embodiment, Cas protein is catalytically deficient (dCas).

In one embodiment, Cas protein is Cas13. In one embodiment, the Cas protein is PspCas13b, PspCas13b Truncation, AdmCas13d, AspCas13b, AspCas13c, BmaCas13a, BzoCas13b, CamCas13a, CcaCas13b, Cga2Cas13a, CgaCas13a, EbaCas13a, EreCas13a, EsCas13d, FbrCas13b, FnbCas13c, FndCas13c, FnfCas13c, FnsCas13c, FpeCas13c, FulCas13c, HheCas13a, LbfCas13a, LbmCas13a, LbnCas13a, LbuCas13a, LseCas13a, LshCas13a, LspCas13a, Lwa2cas13a, LwaCas13a, LweCas13a, PauCas13b, PbuCas13b, PgiCas13b, PguCas13b, Pin2Cas13b, Pin3Cas13b, PinCas13b, Pprcas13a, PsaCas13b, PsmCas13b, RaCas13d, RanCas13b, RcdCas13a, RcrCas13a, RcsCas13a, RfxCas13d, UrCas13d, dPspCas13b, PspCas13b A133H, PspCas13b A1058H, dPspCas13b truncation, dAdmCas13d, dAspCas13b, dAspCas13c, dBmaCas13a, dBzoCas13b, dCamCas13a, dCcaCas13b, dCga2Cas13a, dCgaCas13a, dEbaCas13a, dEreCas13a, dEsCas13d, dFbrCas13b, dFnbCas13c, dFndCas13c, dFnfCas13c, dFnsCas13c, dFpeCas13c, dFulCas13c, dHheCas13a, dLbfCas13a, dLbmCas13a, dLbnCas13a, dLbuCas13a, dLseCas13a, dLshCas13a, dLspCas13a, dLwa2cas13a, dLwaCas13a, dLweCas13a, dPauCas13b, dPbuCas13b, dPgiCas13b, dPguCas13b, dPin2Cas13b, dPin3Cas13b, dPinCas13b, dPprCas13a, dPsaCas13b, dPsmCas13b, dRaCas13d, dRanCas13b, dRcdCas13a, dRcrCas13a, dRcsCas13a, dRfxCas13d, dUrCas13d, or a variant thereof. Additional Cas proteins are known in the art (e.g., Konermann et al., Cell, 2018, 173:665-676 e14, Yan et al., Mol Cell, 2018, 7:327-339 e5; Cox, D. B. T., et al., Science, 2017, 358: 1019-1027; Abudayyeh et al., Nature, 2017, 550: 280-284, Gootenberg et al., Science, 2017, 356: 438-442; and East-Seletsky et al., Mol Cell, 2017, 66: 373-383 e3, which are herein incorporated by reference).

In one embodiment, the Cas protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the Cas protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the Cas protein comprises a sequence of one of SEQ ID NOs:1-48. In one embodiment, the Cas protein comprises a sequence of one of SEQ ID NOs:1-48.

In one embodiment, the NLS is a retrotransposon NLS. In one embodiment, the NLS is derived from Ty1, yeast GAL4, SKI3, L29 or histone H2B proteins, polyoma virus large T protein, VP1 or VP2 capsid protein, SV40 VP1 or VP2 capsid protein, Adenovirus Ela or DBP protein, influenza virus NS1 protein, hepatitis vims core antigen or the mammalian lamin, c-myc, max, c-myb, p53, c-erbA, jun, Tax, steroid receptor or Mx proteins, Nucleoplasmin (NPM2), Nucleophosmin (NPM1), or simian vims 40 ("SV40") T-antigen.

In one embodiment, the NLS is a Ty1 or Ty1-derived NLS, a Ty2 or Ty2-derived NLS or a MAK11 or MAK11-derived NLS. In one embodiment, the Ty1 NLS comprises an amino acid sequence of SEQ ID NO:75. In one embodiment, the Ty2 NLS comprises an amino acid sequence of SEQ ID NO:76. In one embodiment, the MAK11 NLS comprises an amino acid sequence of SEQ ID NO:77. In one embodiment, the NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:75-695. In one embodiment, the NLS protein comprises a sequence of one of SEQ ID NOs: 75-695.

In one embodiment, the NLS is a Ty1-like NLS. For example, in one embodiment, the Ty1-like NLS comprises KKRX motif. In one embodiment, the Ty1-like NLS comprises KKRX motif at the N-terminal end. In one embodiment, the Ty1-like NLS comprises KKR motif. In one embodiment, the Ty1-like NLS comprises KKR motif at the C-terminal end. In one embodiment, the Ty1-like NLS comprises a KKRX and a KKR motif. In one embodiment, the Ty1-like NLS comprises a KKRX at the N-terminal end and a KKR motif at the C-terminal end. In one embodiment, the Ty1-like NLS comprises at least 20 amino acids. In one embodiment, the Ty1-like NLS comprises between 20 and 40 amino acids. In one embodiment, the Ty1-like NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:83-695. In one embodiment, the NLS comprises a sequence of one of SEQ ID NOs: 83-695, wherein the sequence comprises one or more, two or more, three or more, four or more, five or more, six or more, seven or more, eight or more, nine or more, or ten or more, insertions, deletions or substitutions. In one embodiment, the Ty1-like NLS protein comprises a sequence of one of SEQ ID NOs: 83-695.

In one embodiment, the NLS comprises two copies of the same NLS. For example, in one embodiment, the NLS comprises a multimer of a first Ty1-derived NLS and a second Ty1-derived NLS.

In one embodiment, the fusion protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:702. In one embodiment, the fusion protein comprises a sequence of SEQ ID NO: 702.

HilightR

In one aspect, the present invention is based on the development of novel fusions of editing proteins and fluorescent proteins which are effectively delivered to the nucleus. These fusion proteins combine the visualization capability of the fluorescent protein and the programmable DNA targeting capability of catalytically dead Cas. In one embodiment, the present invention provides fusion proteins comprising a CRISPR-associated (Cas) protein having a first amino acid sequence, and a fluorescent protein having a second amino acid sequence. In one embodiment, the fusion protein comprises a nuclear localization signal having a third amino acid sequence. In one embodiment, the fusion protein comprises a linker having a fourth amino acid sequence. In one embodiment, the linker links the Cas protein and fluorescent protein. In one embodiment, the fusion protein comprises a purification and/or detection tag having a fifth amino acid sequence.

In one embodiment, the editing protein includes, but is not limited to, a CRISPR-associated (Cas) protein, a zinc finger nuclease (ZFN) protein, and a protein having a DNA or RNA binding domain.

Non-limiting examples of Cas proteins include Cas1, Cas1B, Cas2, Cas3, Cas4, Cas5, Cash, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, SpCas9, StCas9, NmCas9, SaCas9, CjCas9, CjCas9, AsCpf1, LbCpf1, FnCpf1, VRER SpCas9, VQR SpCas9, xCas9 3.7, homologs thereof, orthologs thereof, or modified versions thereof. In some embodiments, the Cas protein has DNA or RNA cleavage activity. In some embodiments, the Cas protein directs cleavage of one or both strands of a nucleic acid molecule at the location of a target sequence, such as within the target sequence and/or within the complement of the target sequence. In some embodiments, the Cas protein directs cleavage of one or both strands within about 1, 2, 3, 4, 5, 6, 7, 8, 9, 10, 15, 20, 25, 50, 100, 200, 500, or more base pairs from the first or last nucleotide of a target sequence. In one embodiment, the Cas protein is Cas9, Cas13, or Cpf1. In one embodiment, Cas protein is catalytically deficient (dCas).

In one embodiment, Cas protein is Cas13. In one embodiment, the Cas protein is PspCas13b, PspCas13b Truncation, AdmCas13d, AspCas13b, AspCas13c, BmaCas13a, BzoCas13b, CamCas13a, CcaCas13b, Cga2Cas13a, CgaCas13a, EbaCas13a, EreCas13a, EsCas13d, FbrCas13b, FnbCas13c, FndCas13c, FnfCas13c, FnsCas13c, FpeCas13c, FulCas13c, HheCas13a, LbfCas13a, LbmCas13a, LbnCas13a, LbuCas13a, LseCas13a, LshCas13a, LspCas13a, Lwa2cas13a, LwaCas13a, LweCas13a, PauCas13b, PbuCas13b, PgiCas13b, PguCas13b, Pin2Cas13b, Pin3Cas13b, PinCas13b, Pprcas13a, PsaCas13b, PsmCas13b, RaCas13d, RanCas13b, RcdCas13a, RcrCas13a, RcsCas13a, RfxCas13d, UrCas13d, dPspCas13b, PspCas13b A133H, PspCas13b A1058H, dPspCas13b truncation, dAdmCas13d, dAspCas13b, dAspCas13c, dBmaCas13a, dBzoCas13b, dCamCas13a, dCcaCas13b, dCga2Cas13a, dCgaCas13a, dEbaCas13a, dEreCas13a, dEsCas13d, dFbrCas13b, dFnbCas13c, dFndCas13c, dFnfCas13c, dFnsCas13c, dFpeCas13c, dFulCas13c, dHheCas13a, dLbfCas13a, dLbmCas13a, dLbnCas13a, dLbuCas13a, dLseCas13a, dLshCas13a, dLspCas13a, dLwa2cas13a, dLwaCas13a, dLweCas13a, dPauCas13b, dPbuCas13b, dPgiCas13b, dPguCas13b, dPin2Cas13b, dPin3Cas13b, dPinCas13b, dPprCas13a, dPsaCas13b, dPsmCas13b, dRaCas13d, dRanCas13b, dRcdCas13a, dRcrCas13a, dRcsCas13a, dRfxCas13d, or dUrCas13d. Additional Cas proteins are known in the art (e.g., Konermann et al., Cell, 2018, 173:665-676 e14, Yan et al., Mol Cell, 2018, 7:327-339 e5; Cox, D. B. T., et al., Science, 2017, 358: 1019-1027; Abudayyeh et al., Nature, 2017, 550: 280-284, Gootenberg et al., Science, 2017, 356: 438-442; and East-Seletsky et al., Mol Cell, 2017, 66: 373-383 e3, which are herein incorporated by reference).

In one embodiment, the Cas protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the Cas protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the Cas protein comprises a sequence of a variant of one of SEQ ID NOs:1-48, wherein the variant renders the Cas protein catalytically inactive. In one embodiment, the Cas protein comprises a sequence of one of SEQ ID NOs:1-46 having one or more insertions, deletions or substitutions, wherein the one or more insertions, deletions or substitutions renders the Cas protein catalytically inactive. In one embodiment, the Cas protein comprises a sequence of one of SEQ ID NOs:1-48. In one embodiment, the Cas protein comprises a sequence of one of SEQ ID NOs:47-48.

In one embodiment, the NLS is a retrotransposon NLS. In one embodiment, the NLS is derived from Ty1, yeast GAL4, SKI3, L29 or histone H2B proteins, polyoma virus large T protein, VP1 or VP2 capsid protein, SV40 VP1 or VP2 capsid protein, Adenovirus El a or DBP protein, influenza virus NS1 protein, hepatitis vims core antigen or the mammalian lamin, c-myc, max, c-myb, p53, c-erbA, jun, Tax, steroid receptor or Mx proteins, Nucleoplasmin (NPM2), Nucleophosmin (NPM1), or simian vims 40 ("SV40") T-antigen. In one embodiment, the NLS is a Ty1 or Ty1-derived NLS, a Ty2 or Ty2-derived NLS or a MAK11 or MAK11-derived NLS. In one embodiment, the Ty1 NLS comprises an amino acid sequence of SEQ ID NO:75. In one embodiment, the Ty2 NLS comprises an amino acid sequence of SEQ ID NO:76. In one embodiment, the MAK11 NLS comprises an amino acid sequence of SEQ ID NO:77. In one embodiment, the NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:75-695. In one embodiment, the NLS protein comprises a sequence of one of SEQ ID NOs: 75-695.

In one embodiment, the NLS is a Ty1-like NLS. For example, in one embodiment, the Ty1-like NLS comprises KKRX motif. In one embodiment, the Ty1-like NLS comprises KKRX motif at the N-terminal end. In one embodiment, the Ty1-like NLS comprises KKR motif. In one embodiment, the Ty1-like NLS comprises KKR motif at the C-terminal end. In one embodiment, the Ty1-like NLS comprises a KKRX and a KKR motif. In one embodiment, the Ty1-like NLS comprises a KKRX at the N-terminal end and a KKR motif at the C-terminal end. In one embodiment, the Ty1-like NLS comprises at least 20 amino acids. In one embodiment, the Ty1-like NLS comprises between 20 and 40 amino acids. In one embodiment, the Ty1-like NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:83-695. In one embodiment, the NLS comprises a sequence of one of SEQ ID NOs: 83-695, wherein the sequence comprises one or more, two or more, three or more, four or more, five or more, six or more, seven or more, eight or more, nine or more, or ten or more, insertions, deletions or substitutions. In one embodiment, the Ty1-like NLS protein comprises a sequence of one of SEQ ID NOs: 83-695.

In one embodiment, the NLS comprises two copies of the same NLS. For example, in one embodiment, the NLS comprises a multimer of a first Ty1-derived NLS and a second Ty1-derived NLS.

In one embodiment, the fluorescent protein is eGFP, mCherry, mCherry-MBNL1, sfGFP, sfGFP(1-10), sfGFP(1-10)-L-(11), 7xS11, sfCherry, S11, Emerald, Superfolder GFP, Azami Green, mWasabi, TagGFP, TurboGFP, AcGFP, ZsGreen, T-Sapphire, Blue Fluorescent Proteins, EBFP, EBFP2, Azurite, mTagBFP, Cyan Fluorescent Proteins, eCFP, mECFP, Cerulean, mTurquoise, CyPet, AmCyan1, Midori-Ishi Cyan, TagCFP, mTFP1 (Teal), Yellow Fluorescent Proteins, EYFP, Topaz, Venus, mCitrine, YPet, TagYFP, PhiYFP, ZsYellow1, mBanana, Orange Fluorescent Proteins, Kusabira Orange, Kusabira Orange2, mOrange, mOrange2, dTomato, dTomato-Tandem, TagRFP, TagRFP-T, DsRed, DsRed2, DsRed-Express (T1), DsRed-Monomer, mTangerine, Red Fluorescent Proteins, mRuby, mApple, mStrawberry, AsRed2, mRFP1, JRed, HcRed1, mRaspberry, dKeima-Tandem, HcRed-Tandem, mPlum, or AQ143.

In one embodiment, the fluorescent protein is eGFP, mCherry, sfGFP, sfGFP(1-10), sfGFP(1-10)-L-(11), sfCherry, or 7xS11. In one embodiment, the fluorescent protein comprises an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:59-66. In one embodiment, the fluorescent protein comprises an amino acid sequence of one of SEQ ID NOs: 59-66.

In one embodiment, the fusion protein comprises a purification and/or detection tag. In one embodiment, the tag is on the N-terminal end of the fusion protein. In one embodiment, the tag comprises an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:74. In one embodiment, the tag comprises an amino acid sequence of SEQ ID NO: 7474.

In one embodiment, the fusion protein comprises a linker. In one embodiment, the linker links the Cas protein and fluorescent protein. In one embodiment, the linker is connected to the C-terminal end of the Cas protein and to the N-terminal end of the fluorescent protein. In one embodiment, the linker comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:67-73. In one embodiment, the linker comprises a sequence at of one of SEQ ID NOs: 67-73.

In one embodiment, the fusion protein comprises an amino acid sequence 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:699-701. In one embodiment, the fusion protein comprises an amino acid sequence of one of SEQ ID NOs: 699-701.

Postscriptr

In one aspect, the present invention is based on the development of novel fusions of editing proteins and cleavage and/or polyadenylation proteins which are effectively delivered to the nucleus. These fusion proteins combine the catalytic activity of the cleavage and/or polyadenylation protein and the programmable DNA targeting capability of catalytically dead Cas. In one embodiment, the present invention provides fusion proteins comprising a CRISPR-associated (Cas) protein having a first amino acid sequence, and a cleavage and/or polyadenylation protein having a second amino acid sequence. In one embodiment, the fusion protein comprises a nuclear localization signal having a third amino acid sequence. In one embodiment, the fusion protein comprises a linker having a fourth amino acid sequence. In one embodiment, the linker links the Cas protein and cleavage and/or polyadenylation protein. In one embodiment, the fusion protein comprises a purification and/or detection tag having a fifth amino acid sequence.

In one embodiment, the editing protein includes, but is not limited to, a CRISPR-associated (Cas) protein, a zinc finger nuclease (ZFN) protein, and a protein having a DNA or RNA binding domain.

Non-limiting examples of Cas proteins include Cas1, Cas1B, Cas2, Cas3, Cas4, Cas5, Cash, Cas7, Cas8, Cas9, Cas10, Csy1, Csy2, Csy3, Cse1, Cse2, Csc1, Csc2, Csa5, Csn2. Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, SpCas9, StCas9, NmCas9, SaCas9, CjCas9, CjCas9, AsCpf1, LbCpf1, FnCpf1, VRER SpCas9, VQR SpCas9, xCas9 3.7, homologs thereof, orthologs thereof, or modified versions thereof. In some embodiments, the Cas protein has DNA or RNA cleavage activity. In some embodiments, the Cas protein directs cleavage of one or both strands of a nucleic acid molecule at the location of a target sequence, such as within the target sequence and/or within the complement of the target sequence. In some embodiments, the Cas protein directs cleavage of one or both strands within about 1, 2, 3, 4, 5, 6, 7, 8, 9, 10, 15, 20, 25, 50, 100, 200, 500, or more base pairs from the first or last nucleotide of a target sequence. In one embodiment, the Cas protein is Cas9, Cas13, or Cpf1. In one embodiment, Cas protein is catalytically deficient (dCas).

In one embodiment, Cas protein is Cas13. In one embodiment, the Cas protein is PspCas13b, PspCas13b Truncation, AdmCas13d, AspCas13b, AspCas13c, BmaCas13a, BzoCas13b, CamCas13a, CcaCas13b, Cga2Cas13a, CgaCas13a, EbaCas13a, EreCas13a, EsCas13d, FbrCas13b, FnbCas13c, FndCas13c, FnfCas13c, FnsCas13c, FpeCas13c, FulCas13c, HheCas13a, LbfCas13a, LbmCas13a, LbnCas13a, LbuCas13a, LseCas13a, LshCas13a, LspCas13a, Lwa2cas13a, LwaCas13a, LweCas13a, PauCas13b, PbuCas13b, PgiCas13b, PguCas13b, Pin2Cas13b, Pin3Cas13b, PinCas13b, PprcasI3a, PsaCas13b, PsmCas13b, RaCas13d, RanCas13b, RcdCas13a, RcrCas13a, RcsCas13a, RfxCas13d, UrCas13d, dPspCas13b, PspCas13b A133H, PspCas13b A1058H, dPspCas13b truncation, dAdmCas13d, dAspCas13b, dAspCas13c, dBmaCas13a, dBzoCas13b, dCamCas13a, dCcaCas13b, dCga2Cas13a, dCgaCas13a, dEbaCas13a, dEreCas13a, dEsCas13d, dFbrCas13b, dFnbCas13c, dFndCas13c, dFnfCas13c, dFnsCas13c, dFpeCas13c, dFulCas13c, dHheCas13a, dLbfCas13a, dLbmCas13a, dLbnCas13a, dLbuCas13a, dLseCas13a, dLshCas13a, dLspCas13a, dLwa2cas13a, dLwaCas13a, dLweCas13a, dPauCas13b, dPbuCas13b, dPgiCas13b, dPguCas13b, dPin2Cas13b, dPin3Cas13b, dPinCas13b, dPprCas13b, dPsaCas13b, dPsmCas13b, dRaCas13d, dRanCas13b, dRcdCas13a, dRcrCas13a, dRcsCas13a, dRfxCas13d, or dUrCas13d. Additional Cas proteins are known in the art (e.g., Konermann et al., Cell, 2018, 173:665-676 e14, Yan et al., Mol Cell, 2018, 7:327-339 e5; Cox, D. B. T., et al., Science, 2017, 358: 1019-1027; Abudayyeh et al., Nature, 2017, 550: 280-284, Gootenberg et al., Science, 2017, 356: 438-442; and East-Seletsky et al., Mol Cell, 2017, 66: 373-383 e3, which are herein incorporated by reference).

In one embodiment, the Cas protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the Cas protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the Cas protein comprises a sequence of a variant of one of SEQ ID NOs:1-48, wherein the variant renders the Cas protein catalytically inactive. In one embodiment, the Cas protein comprises a sequence of one of SEQ ID NOs:1-46 having one or more insertions, deletions or substitutions, wherein the one or more insertions, deletions or substitutions renders the Cas protein catalytically inactive. In one embodiment, the Cas protein comprises a sequence of one of SEQ ID NOs:1-48. In one embodiment, the Cas protein comprises a sequence of one of SEQ ID NOs:47-48.

In one embodiment, the NLS is a retrotransposon NLS. In one embodiment, the NLS is derived from Ty1, yeast GAL4, SKI3, L29 or histone H2B proteins, polyoma virus large T protein, VP1 or VP2 capsid protein, SV40 VP1 or VP2 capsid protein, Adenovirus El a or DBP protein, influenza virus NS1 protein, hepatitis vims core antigen or the mammalian lamin, c-myc, max, c-myb, p53, c-erbA, jun, Tax, steroid receptor or Mx proteins, Nucleoplasmin (NPM2), Nucleophosmin (NPM1), or simian vims 40 ("SV40") T-antigen. In one embodiment, the NLS is a Ty1 or Ty1-derived NLS, a Ty2 or Ty2-derived NLS or a MAK11 or MAK11-derived NLS. In one embodiment, the Ty1 NLS comprises an amino acid sequence of SEQ ID NO:75. In one embodiment, the Ty2 NLS comprises an amino acid sequence of SEQ ID NO:76. In one embodiment, the MAK11 NLS comprises an amino acid sequence of SEQ ID NO:77. In one embodiment, the NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:75-695. In one embodiment, the NLS protein comprises a sequence of one of SEQ ID NOs: 75-695.

In one embodiment, the NLS is a Ty1-like NLS. For example, in one embodiment, the Ty1-like NLS comprises KKRX motif. In one embodiment, the Ty1-like NLS comprises KKRX motif at the N-terminal end. In one embodiment, the Ty1-like NLS comprises KKR motif. In one embodiment, the Ty1-like NLS comprises KKR motif at the C-terminal end. In one embodiment, the Ty1-like NLS comprises a KKRX and a KKR motif. In one embodiment, the Ty1-like NLS comprises a KKRX at the N-terminal end and a KKR motif at the C-terminal end. In one embodiment, the Ty1-like NLS comprises at least 20 amino acids. In one embodiment, the Ty1-like NLS comprises between 20 and 40 amino acids. In one embodiment, the Ty1-like NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:83-695. In one embodiment, the NLS comprises a sequence of one of SEQ ID NOs: 83-695, wherein the sequence comprises one or more, two or more, three or more, four or more, five or more, six or more, seven or more, eight or more, nine or more, or ten or more, insertions, deletions or substitutions. In one embodiment, the Ty1-like NLS protein comprises a sequence of one of SEQ ID NOs: 83-695.

In one embodiment, the NLS comprises two copies of the same NLS. For example, in one embodiment, the NLS comprises a multimer of a first Ty1-derived NLS and a second Ty1-derived NLS.

In one embodiment, the cleavage and/or polyadenylation protein is an RNA binding protein of the human 3' end processing machinery. In one embodiment, the cleavage and/or polyadenylation protein is CPSF30, WDR33, or NUDT21. In one embodiment, the cleavage and/or polyadenylation protein is NUDT21. In one embodiment, the cleavage and/or polyadenylation protein is NUDT21, a NUDT21 mutation, a NUDT21 dimer, a NUDT21 fusion protein or any combination thereof. In one embodiment, the cleavage and/or polyadenylation protein is human NUDT21, Worm NUDT21, Fly NUDT21, Zebrafish NUDT21 NUDT21_R63S, NUDT21_F103A, or a tandem dimer of NUDT21.

In one embodiment, the cleavage and/or polyadenylation protein comprises an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:49-58. In one embodiment, the cleavage and/or polyadenylation protein comprises an amino acid sequence of one of SEQ ID NOs: 49-58. In one embodiment, the cleavage and/or polyadenylation protein comprises an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 51-58. In one embodiment, the cleavage and/or polyadenylation protein comprises an amino acid sequence of SEQ ID NO:51-58.

In one embodiment, the fusion protein comprises a purification and/or detection tag. In one embodiment, the tag is on the N-terminal end of the fusion protein. In one embodiment, the tag comprises an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:74. In one embodiment, the tag comprises an amino acid sequence of SEQ ID NO: 74.

In one embodiment, the fusion protein comprises a linker. In one embodiment, the linker links the Cas protein and cleavage and/or polyadenylation protein. In one embodiment, the linker is connected to the C-terminal end of the Cas protein and to the N-terminal end of the cleavage and/or polyadenylation protein. In one embodiment, the linker comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:67-73. In one embodiment, the linker comprises a sequence at of one of SEQ ID NOs: 67-73.

In one embodiment, the fusion protein comprises an amino acid sequence 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:696-698. In one embodiment, the fusion protein comprises an amino acid sequence of one of SEQ ID NOs:696-698.

The fusion protein of the present invention may be made using chemical methods. For example, fusion protein can be synthesized by solid phase techniques (Roberge J Y et al (1995) Science 269: 202-204), cleaved from the resin, and purified by preparative high-performance liquid chromatography. Automated synthesis may be achieved, for example, using the ABI 431 A Peptide Synthesizer (Perkin Elmer) in accordance with the instructions provided by the manufacturer.

The invention should also be construed to include any form of a fusion protein having substantial homology to a fusion-protein disclosed herein. In one embodiment, a fusion protein which is "substantially homologous" is about 50% homologous, about 70% homologous, about 80% homologous, about 90% homologous, about 95% homologous, or about 99% homologous to amino acid sequence of a fusion-protein disclosed herein.

The fusion protein may alternatively be made by recombinant means or by cleavage from a longer polypeptide. The composition of a fusion protein may be confirmed by amino acid analysis or sequencing.

The variants of the fusion protein according to the present invention may be (i) one in which one or more of the amino acid residues are substituted with a conserved or non-conserved amino acid residue and such substituted amino acid residue may or may not be one encoded by the genetic code, (ii) one in which there are one or more modified amino acid residues, e.g., residues that are modified by the attachment of substituent groups, (iii) one in which the peptide is an alternative splice variant of the fusion protein of the present invention, (iv) fragments of the peptides and/or (v) one in which the fusion protein is fused with another peptide, such as a leader or secretory sequence or a sequence which is employed for purification (for example, His-tag) or for detection (for example, Sv5 epitope tag). The fragments include peptides generated via proteolytic cleavage (including multi-site proteolysis) of an original sequence. Variants may be post-translationally, or chemically modified. Such variants are deemed to be within the scope of those skilled in the art from the teaching herein.

As known in the art the "similarity" between two fusion proteins is determined by comparing the amino acid sequence and its conserved amino acid substitutes of one polypeptide to a sequence of a second polypeptide. Variants are defined to include peptide sequences different from the original sequence. In one embodiment, variants are different from the original sequence in less than 40% of residues per segment of interest different from the original sequence in less than 25% of residues per segment of interest, different by less than 10% of residues per segment of interest, or different from the original protein sequence in just a few residues per segment of interest and at the same time sufficiently homologous to the original sequence to preserve the functionality of the original sequence and/or the ability to stimulate the differentiation of a stem cell into the osteoblast lineage. The present invention includes amino acid sequences that are at least 60%, 65%, 70%, 72%, 74%, 76%, 78%, 80%, 90%, or 95% similar or identical to the original amino acid sequence. The degree of identity between two peptides is determined using computer algorithms and methods that are widely known for the persons skilled in the art. The identity between two amino acid sequences may be determined by using the BLASTP algorithm [BLAST Manual, Altschul, S., et al., NCBI NLM NIH Bethesda, Md. 20894, Altschul, S., et al., J. Mol. Biol. 215: 403-410 (1990)].

The fusion protein of the invention can be post-translationally modified. For example, post-translational modifications that fall within the scope of the present invention include signal peptide cleavage, glycosylation, acetylation, isoprenylation, proteolysis, myristoylation, protein folding and proteolytic processing, etc. Some modifications or processing events require introduction of additional biological machinery. For example, processing events, such as signal peptide cleavage and core glycosylation, are examined by adding canine microsomal membranes or Xenopus egg extracts (U.S. Pat. No. 6,103,489) to a standard translation reaction.

The fusion protein of the invention may include unnatural amino acids formed by post-translational modification or by introducing unnatural amino acids during translation. A variety of approaches are available for introducing unnatural amino acids during protein translation.

A fusion protein of the invention may be phosphorylated using conventional methods such as the method described in Reedijk et al. (The EMBO Journal 11(4):1365, 1992).

Cyclic derivatives of the fusion proteins of the invention are also part of the present invention. Cyclization may allow the fusion protein to assume a more favorable conformation for association with other molecules. Cyclization may be achieved using techniques known in the art. For example, disulfide bonds may be formed between two appropriately spaced components having free sulfhydryl groups, or an amide bond may be formed between an amino group of one component and a carboxyl group of another component. Cyclization may also be achieved using an azobenzene-containing amino acid as described by Ulysse, L., et al., J. Am. Chem. Soc. 1995, 117, 8466-8467. The components that form the bonds may be side chains of amino acids, non-amino acid components or a combination of the two. In an embodiment of the invention, cyclic peptides may comprise a beta-turn in the right position. Beta-turns may be introduced into the peptides of the invention by adding the amino acids Pro-Gly at the right position.

It may be desirable to produce a cyclic fusion protein which is more flexible than the cyclic peptides containing peptide bond linkages as described above. A more flexible peptide may be prepared by introducing cysteines at the right and left position of the peptide and forming a disulphide bridge between the two cysteines. The two cysteines are arranged so as not to deform the beta-sheet and turn. The peptide is more flexible as a result of the length of the disulfide linkage and the smaller number of hydrogen bonds in the beta-sheet portion. The relative flexibility of a cyclic peptide can be determined by molecular dynamics simulations.

The invention also relates to peptides comprising a fusion protein comprising Cas13 and a fluorescent protein or Cas13 and a cleavage and/or polyadenylation protein, wherein the fusion protein is itself fused to, or integrated into, a target protein, and/or a targeting domain capable of directing the chimeric protein to a desired cellular component or cell type or tissue. The chimeric proteins may also contain additional amino acid sequences or domains. The chimeric proteins are recombinant in the sense that the various components are from different sources, and as such are not found together in nature (i.e., are heterologous).

In one embodiment, the targeting domain can be a membrane spanning domain, a membrane binding domain, or a sequence directing the protein to associate with for example vesicles or with the nucleus. In one embodiment, the targeting domain can target a peptide to a particular cell type or tissue. For example, the targeting domain can be a cell surface ligand or an antibody against cell surface antigens of a target tissue. A targeting domain may target the peptide of the invention to a cellular component.

A peptide of the invention may be synthesized by conventional techniques. For example, the peptides or chimeric proteins may be synthesized by chemical synthesis using solid phase peptide synthesis. These methods employ either solid or solution phase synthesis methods (see for example, J. M. Stewart, and J. D. Young, Solid Phase Peptide Synthesis, $2^{nd}$ Ed., Pierce Chemical Co., Rockford Ill. (1984) and G. Barany and R. B. Merrifield, The Peptides: Analysis Synthesis, Biology editors E. Gross and J. Meienhofer Vol. 2 Academic Press, New York, 1980, pp. 3-254 for solid phase synthesis techniques; and M Bodansky, Principles of Peptide Synthesis, Springer-Verlag, Berlin 1984, and E. Gross and J. Meienhofer, Eds., The Peptides: Analysis, Synthesis, Biology, suprs, Vol 1, for classical solution synthesis). By way of example, a peptide of the invention may be synthesized using 9-fluorenyl methoxycarbonyl (Fmoc) solid phase chemistry with direct incorporation of phosphothreonine as the N-fluorenylmethoxy-carbonyl-O-benzyl-L-phosphothreonine derivative.

N-terminal or C-terminal fusion proteins comprising a peptide or chimeric protein of the invention conjugated with other molecules may be prepared by fusing, through recombinant techniques, the N-terminal or C-terminal of the peptide or chimeric protein, and the sequence of a selected protein or selectable marker with a desired biological function. The resultant fusion proteins contain the fusion protein fused to the selected protein or marker protein as described herein. Examples of proteins which may be used to prepare fusion proteins include immunoglobulins, glutathione-S-transferase (GST), hemagglutinin (HA), and truncated myc.

Peptides of the invention may be developed using a biological expression system. The use of these systems allows the production of large libraries of random peptide sequences and the screening of these libraries for peptide sequences that bind to particular proteins. Libraries may be produced by cloning synthetic DNA that encodes random peptide sequences into appropriate expression vectors (see Christian et al 1992, J. Mol. Biol. 227:711; Devlin et al, 1990 Science 249:404; Cwirla et al 1990, Proc. Natl. Acad, Sci. USA, 87:6378). Libraries may also be constructed by concurrent synthesis of overlapping peptides (see U.S. Pat. No. 4,708,871).

The peptides and chimeric proteins of the invention may be converted into pharmaceutical salts by reacting with inorganic acids such as hydrochloric acid, sulfuric acid, hydrobromic acid, phosphoric acid, etc., or organic acids such as formic acid, acetic acid, propionic acid, glycolic acid, lactic acid, pyruvic acid, oxalic acid, succinic acid, malic acid, tartaric acid, citric acid, benzoic acid, salicylic acid, benezenesulfonic acid, and toluenesulfonic acids.

Nucleic Acids

In one aspect, the present invention is based on the development of nucleic acids encoding novel fusions of editing proteins which are effectively delivered to the nucleus. In one embodiment, the nucleic acid encodes a fusion protein that can be effectively delivered to the nucleus and is capable of cleaving nuclear RNA. In one embodiment, the nucleic acid encodes a fusion protein that can be effectively delivered to the nucleus and is capable of visualizing nuclear RNA. In one embodiment, the nucleic acid encodes a fusion protein that can be effectively delivered to the nucleus and is capable of modulating the cleavage and/or polyadenylation of nuclear RNA.

EraseR

In one embodiment, the present invention provides a nucleic acid molecule encoding a fusion protein. In one embodiment, the nucleic acid molecule comprises a nucleic acid sequence encoding an editing protein; and a nucleic acid sequence encoding a nuclear localization signal (NLS).

In one embodiment, the editing protein includes, but is not limited to, a CRISPR-associated (Cas) protein, a zinc finger nuclease (ZFN) protein, and a protein having a DNA or RNA binding domain.

Non-limiting examples of Cas proteins include Cas1, Cas1B, Cas2, Cas3, Cas4, Cas5, Cash, Cas7, Cas8, Cas9, Cas10, Csy1, Csy2, Csy3, Cse1, Cse2, Csc1, Csc2, Csa5, Csn2. Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, SpCas9, StCas9, NmCas9, SaCas9, CjCas9, CjCas9, AsCpf1, LbCpf1, FnCpf1, VRER SpCas9, VQR SpCas9, xCas9 3.7, homologs thereof, orthologs thereof, or modified versions thereof. In some embodiments, the Cas protein has DNA or RNA cleavage activity. In some embodiments, the Cas protein directs cleavage of one or both strands of a nucleic acid molecule at the location of a target sequence, such as within the target sequence and/or within the complement of the target sequence. In some embodiments, the Cas protein directs cleavage of one or both strands within about 1, 2, 3, 4, 5, 6, 7, 8, 9, 10, 15, 20, 25, 50, 100, 200, 500, or more base pairs from the first or last nucleotide of a target sequence. In one embodiment, the Cas protein is Cas9, Cas13, or Cpf1. In one embodiment, Cas protein is catalytically deficient (dCas).

In one embodiment, Cas protein is Cas13. In one embodiment, the Cas protein is PspCas13b, PspCas13b Truncation, AdmCas13d, AspCas13b, AspCas13c, BmaCas13a, BzoCas13b, CamCas13a, CcaCas13b, Cga2Cas13a, CgaCas13a, EbaCas13a, EreCas13a, EsCas13d, FbrCas13b, FnbCas13c, FndCas13c, FnfCas13c, FnsCas13c, FpeCas13c, FulCas13c, HheCas13a, LbfCas13a, LbmCas13a, LbnCas13a, LbuCas13a, LseCas13a, LshCas13a, LspCas13a, Lwa2cas13a, LwaCas13a, LweCas13a, PauCas13b, PbuCas13b, PgiCas13b, PguCas13b, Pin2Cas13b, Pin3Cas13b, PinCas13b, Pprcas13a, PsaCas13b, PsmCas13b, RaCas13d, RanCas13b, RcdCas13a, RcrCas13a, RcsCas13a, RfxCas13d, UrCas13d, dPspCas13b, PspCas13b A133H, PspCas13b A1058H, dPspCas13b truncation, dAdmCas13d, dAspCas13b, dAspCas13c, dBmaCas13a, dBzoCas13b, dCamCas13a, dCcaCas13b, dCga2Cas13a, dCgaCas13a, dEbaCas13a, dEreCas13a, dEsCas13d, dFbrCas13b, dFnbCas13c, dFndCas13c, dFnfCas13c, dFnsCas13c, dFpeCas13c, dFulCas13c, dHheCas13a, dLbfCas13a, dLbmCas13a, dLbnCas13a, dLbuCas13a, dLseCas13a, dLshCas13a, dLspCas13a, dLwa2cas13a, dLwaCas13a, dLweCas13a, dPauCas13b, dPbuCas13b, dPgiCas13b, dPguCas13b, dPin2Cas13b, dPin3Cas13b, dPinCas13b, dPprCas13a, dPsaCas13b, dPsmCas13b, dRaCas13d, dRanCas13b, dRcdCas13a, dRcrCas13a, dRcsCas13a, dRfxCas13d, or dUrCas13d. Additional Cas proteins are known in the art (e.g., Konermann et al., Cell, 2018, 173:665-676 e14, Yan et al., Mol Cell, 2018, 7:327-339 e5; Cox, D. B. T., et al., Science, 2017, 358: 1019-1027; Abudayyeh et al., Nature, 2017, 550: 280-284, Gootenberg et al., Science, 2017, 356: 438-442; and East-Seletsky et al., Mol Cell, 2017, 66: 373-383 e3, which are herein incorporated by reference).

In one embodiment, the nucleic acid sequence encoding a Cas protein comprises a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the nucleic acid sequence encoding a Cas protein comprises a nucleic acid sequence encoding an amino acid sequence of one of SEQ ID NOs:1-48. In one embodiment, the nucleic acid sequence encoding a Cas protein comprises a nucleic acid sequence encoding an amino acid sequence of one of SEQ ID NOs:1-46.

In one embodiment, the nucleic acid sequence encoding a Cas protein comprises a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 705-708. In one embodiment, the nucleic acid sequence encoding a Cas protein comprises a nucleic acid sequence of one of SEQ ID NOs:705-708. In one embodiment, the nucleic acid sequence encoding a Cas protein comprises a nucleic acid sequence of one of SEQ ID NOs:707-708.

In one embodiment, the NLS is a retrotransposon NLS. In one embodiment, the NLS is derived from Ty1, yeast GAL4, SKI3, L29 or histone H2B proteins, polyoma virus large T protein, VP1 or VP2 capsid protein, SV40 VP1 or VP2 capsid protein, Adenovirus El a or DBP protein, influenza virus NS1 protein, hepatitis vims core antigen or the mammalian lamin, c-myc, max, c-myb, p53, c-erbA, jun, Tax, steroid receptor or Mx proteins, Nucleoplasmin (NPM2), Nucleophosmin (NPM1), or simian vims 40 ("SV40") T-antigen.

In one embodiment, the NLS is a Ty1 or Ty1-derived NLS, a Ty2 or Ty2-derived NLS or a MAK11 or MAK11-derived NLS. In one embodiment, the Ty1 NLS comprises an amino acid sequence of SEQ ID NO:75. In one embodiment, the Ty2 NLS comprises an amino acid sequence of SEQ ID NO:76. In one embodiment, the MAK11 NLS comprises an amino acid sequence of SEQ ID NO:77.

In one embodiment, the NLS is a Ty1-like NLS. For example, in one embodiment, the Ty1-like NLS comprises KKRX motif. In one embodiment, the Ty1-like NLS comprises KKRX motif at the N-terminal end. In one embodiment, the Ty1-like NLS comprises KKR motif. In one embodiment, the Ty1-like NLS comprises KKR motif at the C-terminal end. In one embodiment, the Ty1-like NLS comprises a KKRX and a KKR motif. In one embodiment, the Ty1-like NLS comprises a KKRX at the N-terminal end and a KKR motif at the C-terminal end. In one embodiment, the Ty1-like NLS comprises at least 20 amino acids. In one embodiment, the Ty1-like NLS comprises between 20 and 40 amino acids. In one embodiment, the Ty1-like NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:83-695. In one embodiment, the NLS comprises a sequence of one of SEQ ID NOs: 83-695, wherein the sequence comprises one or more, two or more, three or more, four or more, five or more, six or more, seven or more, eight or more, nine or more, or ten or more, insertions, deletions or substitutions. In one embodiment, the NLS comprises a sequence of one of SEQ ID NOs: 83-695, wherein the sequence comprises one or more, two or more, three or more, four or more, five or more, six or more, seven or more, eight or more, nine or more, or ten or more, insertions, deletions or substitutions. In one embodiment, the Ty1-like NLS protein comprises a sequence of one of SEQ ID NOs: 83-695.

In one embodiment, the NLS comprises two copies of the same NLS. For example, in one embodiment, the NLS comprises a multimer of a first Ty1-derived NLS and a second Ty1-derived NLS.

In one embodiment, the nucleic acid sequence encoding a NLS comprises a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:75-695. In one embodiment, the nucleic acid sequence encoding a NLS comprises a nucleic acid sequence encoding an amino acid sequence of one of SEQ ID NOs: 75-695. In one embodiment, the nucleic acid sequence encoding a NLS comprises a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:724. In one embodiment, the nucleic acid sequence encoding a NLS comprises a nucleic acid sequence of SEQ ID NO:724.

In one embodiment, the nucleic acid molecule encoding a fusion protein comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:702. In one embodiment, the fusion protein comprises a sequence of SEQ ID NO: 702. In one embodiment, the nucleic acid molecule encoding a fusion protein comprises a sequence encoding an amino acid sequence of SEQ ID NO: 702.

HilightR

In one aspect, the present invention is based on the development of novel nucleic acids encoding fusion proteins comprising an editing protein and a fluorescent protein which are effectively delivered to the nucleus. In one embodiment, the nucleic acid molecule comprises a nucleic acid sequence encoding an editing protein; and a nucleic acid sequence encoding a fluorescent protein. In one embodiment, the nucleic acid molecule comprises a nucleic acid sequence encoding a nuclear localization signal (NLS). In one embodiment, the nucleic acid molecule comprises a nucleic acid sequence encoding a linker. In one embodiment, the nucleic acid molecule comprises a nucleic acid sequence encoding a tag.

In one embodiment, the editing protein includes, but is not limited to, a CRISPR-associated (Cas) protein, a zinc finger nuclease (ZFN) protein, and a protein having a DNA or RNA binding domain.

Non-limiting examples of Cas proteins include Cas1, Cas1B, Cas2, Cas3, Cas4, Cas5, Cash, Cas7, Cas8, Cas9, Cas10, Csy1, Csy2, Csy3, Cse1, Cse2, Csc1, Csc2, Csa5, Csn2. Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, SpCas9, StCas9, NmCas9, SaCas9, CjCas9, CjCas9, AsCpf1, LbCpf1, FnCpf1, VRER SpCas9, VQR SpCas9, xCas9 3.7, homologs thereof, orthologs thereof, or modified versions thereof. In some embodiments, the Cas protein has DNA or RNA cleavage activity. In some embodiments, the Cas protein directs cleavage of one or both strands of a nucleic acid molecule at the location of a target sequence, such as within the target sequence and/or within the complement of the target sequence. In some embodiments, the Cas protein directs cleavage of one or both strands within about 1, 2, 3, 4, 5, 6, 7, 8, 9, 10, 15, 20, 25, 50, 100, 200, 500, or more base pairs from the first or last nucleotide of a target sequence. In one embodiment, the Cas protein is Cas9, Cas13, or Cpf1. In one embodiment, Cas protein is catalytically deficient (dCas).

In one embodiment, Cas protein is Cas13. In one embodiment, the Cas protein is PspCas13b, PspCas13b Truncation, AdmCas13d, AspCas13b, AspCas13c, BmaCas13a, BzoCas13b, CamCas13a, CcaCas13b, Cga2Cas13a, CgaCas13a, EbaCas13a, EreCas13a, EsCas13d, FbrCas13b, FnbCas13c, FndCas13c, FnfCas13c, FnsCas13c, FpeCas13c, FulCas13c, HheCas13a, LbfCas13a, LbmCas13a, LbnCas13a, LbuCas13a, LseCas13a, LshCas13a, LspCas13a, Lwa2cas13a, LwaCas13a, LweCas13a, PauCas13b, PbuCas13b, PgiCas13b, PguCas13b, Pin2Cas13b, Pin3Cas13b, PinCas13b, Pprcas13a, PsaCas13b, PsmCas13b, RaCas13d, RanCas13b, RcdCas13a, RcrCas13a, RcsCas13a, RfxCas13d, UrCas13d, dPspCas13b, PspCas13b A133H, PspCas13b A1058H, dPspCas13b truncation, dAdmCas13d, dAspCas13b, dAspCas13c, dBmaCas13a, dBzoCas13b, dCamCas13a, dCcaCas13b, dCga2Cas13a, dCgaCas13a, dEbaCas13a, dEreCas13a, dEsCas13d, dFbrCas13b, dFnbCas13c, dFndCas13c, dFnfCas13c, dFnsCas13c, dFpeCas13c, dFulCas13c, dHheCas13a, dLbfCas13a, dLbmCas13a, dLbnCas13a, dLbuCas13a, dLseCas13a, dLshCas13a, dLspCas13a, dLwa2cas13a, dLwaCas13a, dLweCas13a, dPauCas13b, dPbuCas13b, dPgiCas13b, dPguCas13b, dPin2Cas13b, dPin3Cas13b, dPinCas13b, dPprCas13a, dPsaCas13a, dPsmCas13b, dRaCas13d, dRanCas13b, dRcdCas13a, dRcrCas13a, dRcsCas13a, dRfxCas13d, or dUrCas13d. Additional Cas proteins are known in the art (e.g., Konermann et al., Cell, 2018, 173:665-676 e14, Yan et al., Mol Cell, 2018, 7:327-339 e5; Cox, D. B. T., et al., Science, 2017, 358: 1019-1027; Abudayyeh et al., Nature, 2017, 550: 280-284, Gootenberg et al., Science, 2017, 356: 438-442; and East-Seletsky et al., Mol Cell, 2017, 66: 373-383 e3, which are herein incorporated by reference).

In one embodiment, the nucleic acid sequence encoding a Cas protein comprises a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the nucleic acid sequence encoding a Cas protein comprises a nucleic acid sequence encoding an amino acid sequence of a variant of one of SEQ ID NOs:1-48, wherein the variant renders the Cas protein catalytically inactive. the nucleic acid sequence encoding a Cas protein comprises a nucleic acid sequence encoding an amino acid sequence of one of SEQ ID NOs:1-46 having one or more insertions, deletions or substitutions, wherein the one or more insertions, deletions or substitutions renders the Cas protein catalytically inactive. the nucleic acid sequence encoding a Cas protein comprises a nucleic acid sequence encoding an amino acid sequence of one of SEQ ID NOs:1-48 the nucleic acid sequence encoding a Cas protein comprises a nucleic acid sequence encoding an amino acid sequence of one of SEQ ID NOs:47-48.

In one embodiment, the nucleic acid sequence encoding a Cas protein comprises a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 705-708. In one embodiment, the nucleic acid sequence encoding a Cas protein comprises a nucleic acid sequence of one of SEQ ID NOs:705-708. In one embodiment, the nucleic acid sequence encoding a Cas protein comprises a nucleic acid sequence of one of SEQ ID NOs:707-708.

In one embodiment, the NLS is a retrotransposon NLS. In one embodiment, the NLS is derived from Ty1, yeast GAL4, SKI3, L29 or histone H2B proteins, polyoma virus large T protein, VP1 or VP2 capsid protein, SV40 VP1 or VP2 capsid protein, Adenovirus E1 a or DBP protein, influenza virus NS1 protein, hepatitis vims core antigen or the mammalian lamin, c-myc, max, c-myb, p53, c-erbA, jun, Tax, steroid receptor or Mx proteins, Nucleoplasmin (NPM2), Nucleophosmin (NPM1), or simian vims 40 ("SV40") T-antigen.

In one embodiment, the NLS is a Ty1 or Ty1-derived NLS, a Ty2 or Ty2-derived NLS or a MAK11 or MAK11-derived NLS. In one embodiment, the Ty1 NLS comprises an amino acid sequence of SEQ ID NO:75. In one embodiment, the Ty2 NLS comprises an amino acid sequence of SEQ ID NO:76. In one embodiment, the MAK11 NLS comprises an amino acid sequence of SEQ ID NO:77.

In one embodiment, the NLS is a Ty1-like NLS. For example, in one embodiment, the Ty1-like NLS comprises KKRX motif. In one embodiment, the Ty1-like NLS comprises KKRX motif at the N-terminal end. In one embodiment, the Ty1-like NLS comprises KKR motif. In one embodiment, the Ty1-like NLS comprises KKR motif at the C-terminal end. In one embodiment, the Ty1-like NLS comprises a KKRX and a KKR motif. In one embodiment, the Ty1-like NLS comprises a KKRX at the N-terminal end and a KKR motif at the C-terminal end. In one embodiment, the Ty1-like NLS comprises at least 20 amino acids. In one embodiment, the Ty1-like NLS comprises between 20 and 40 amino acids. In one embodiment, the Ty1-like NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:83-695. In one embodiment, the NLS comprises a sequence of one of SEQ ID NOs: 83-695, wherein the sequence comprises one or more, two or more, three or more, four or more, five or more, six or more, seven or more, eight or more, nine or more, or ten or more, insertions, deletions or substitutions. In one embodiment, the Ty1-like NLS protein comprises a sequence of one of SEQ ID NOs: 83-695.

In one embodiment, the NLS comprises two copies of the same NLS. For example, in one embodiment, the NLS comprises a multimer of a first Ty1-derived NLS and a second Ty1-derived NLS.

In one embodiment, the nucleic acid sequence encoding a NLS comprises a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:75-695. In one embodiment, the nucleic acid sequence encoding a NLS comprises a nucleic acid sequence encoding an amino acid sequence of one of SEQ ID NOs: 75-695. In one embodiment, the nucleic acid sequence encoding a NLS comprises a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:724. In one embodiment, the nucleic acid sequence encoding a NLS comprises a nucleic acid sequence of SEQ ID NO:724.

In one embodiment, the fluorescent protein is eGFP, mCherry, mCherry-MBNL1, sfGFP, sfGFP(1-10), sfGFP(1-10)-L-(11), sfCherry 7xS11, S11, Emerald, Superfolder GFP, Azami Green, mWasabi, TagGFP, TurboGFP, AcGFP, ZsGreen, T-Sapphire, Blue Fluorescent Proteins, EBFP, EBFP2, Azurite, mTagBFP, Cyan Fluorescent Proteins, eCFP, mECFP, Cerulean, mTurquoise, CyPet, AmCyan1, Midori-Ishi Cyan, TagCFP, mTFP1 (Teal), Yellow Fluorescent Proteins, EYFP, Topaz, Venus, mCitrine, YPet, TagYFP, PhiYFP, ZsYellow1, mBanana, Orange Fluorescent Proteins, Kusabira Orange, Kusabira Orange2, mOrange, mOrange2, dTomato, dTomato-Tandem, TagRFP, TagRFP-T, DsRed, DsRed2, DsRed-Express (T1), DsRed-Monomer, mTangerine, Red Fluorescent Proteins, mRuby, mApple, mStrawberry, AsRed2, mRFP1, JRed, HcRed1, mRaspberry, dKeima-Tandem, HcRed-Tandem, mPlum, or AQ143.

In one embodiment, the fluorescent protein is eGFP, mCherry, sfGFP, sfGFP(1-10), sfGFP(1-10)-L-(11), sfCherry or 7xS11. In one embodiment, nucleic acid molecule comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:59-66. In one embodiment, nucleic acid molecule comprises a sequence encoding an amino acid sequence of one of SEQ ID NOs: 59-66.

In one embodiment, nucleic acid molecule comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 718-721. In one embodiment, nucleic acid molecule comprises a sequence of one of SEQ ID NOs: 718-721.

In one embodiment, the nucleic acid molecule comprises a sequence encoding a tag. In one embodiment, the nucleic acid molecule comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:74. In one embodiment, the nucleic acid molecule comprises a sequence encoding an amino acid sequence of SEQ ID NO: 7474.

In one embodiment, nucleic acid molecule comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:723. In one embodiment, nucleic acid molecule comprises a sequence of SEQ ID NO: 723.

In one embodiment, the nucleic acid molecule comprises a sequence encoding a linker. In one embodiment, the nucleic acid molecule comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 67-73. In one embodiment, the nucleic acid molecule comprises a sequence encoding an amino acid sequence of one of SEQ ID NOs: 67-73.74

In one embodiment, nucleic acid molecule comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:722. In one embodiment, nucleic acid molecule comprises a sequence of SEQ ID NO: 722723.

In one embodiment, the nucleic acid molecule encoding a fusion protein comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 699-701. In one embodiment, the nucleic acid molecule encoding a fusion protein comprises a sequence encoding an amino acid sequence of one of SEQ ID NOs: 699-701.

In one embodiment, the nucleic acid molecule encoding a fusion protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:728-730. In one embodiment, the nucleic acid molecule encoding a fusion protein comprises a sequence of one of SEQ ID NOs:728-730.

PostscriptR

In one aspect, the present invention is based on the development of novel nucleic acids encoding fusion proteins comprising an editing protein and a cleavage and/or polyadenylation protein which are effectively delivered to the nucleus. In one embodiment, the nucleic acid molecule comprises a nucleic acid sequence encoding an editing protein; and a nucleic acid sequence encoding a cleavage and/or polyadenylation. In one embodiment, the nucleic acid molecule comprises a nucleic acid sequence encoding a nuclear localization signal (NLS). In one embodiment, the nucleic acid molecule comprises a nucleic acid sequence encoding a linker. In one embodiment, the nucleic acid molecule comprises a nucleic acid sequence encoding a tag.

In one embodiment, the editing protein includes, but is not limited to, a CRISPR-associated (Cas) protein, a zinc finger nuclease (ZFN) protein, and a protein having a DNA or RNA binding domain.

Non-limiting examples of Cas proteins include Cas1, Cas1B, Cas2, Cas3, Cas4, Cas5, Cash, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, SpCas9, StCas9, NmCas9, SaCas9, CjCas9, CjCas9, AsCpf1, LbCpf1, FnCpf1, VRER SpCas9, VQR SpCas9, xCas9 3.7, homologs thereof, orthologs thereof, or modified versions thereof. In some embodiments, the Cas protein has DNA or RNA cleavage activity. In some embodiments, the Cas protein directs cleavage of one or both strands of a nucleic acid molecule at the location of a target sequence, such as within the target sequence and/or within the complement of the target sequence. In some embodiments, the Cas protein directs cleavage of one or both strands within about 1, 2, 3, 4, 5, 6, 7, 8, 9, 10, 15, 20, 25, 50, 100, 200, 500, or more base pairs from the first or last nucleotide of a target sequence. In one embodiment, the Cas protein is Cas9, Cas13, or Cpf1. In one embodiment, Cas protein is catalytically deficient (dCas).

In one embodiment, Cas protein is Cas13. In one embodiment, the Cas protein is PspCas13b, PspCas13b Truncation, AdmCas13d, AspCas13b, AspCas13c, BmaCas13a, BzoCas13b, CamCas13a, CcaCas13b, Cga2Cas13a, CgaCas13a, EbaCas13a, EreCas13a, EsCas13d, FbrCas13b, FnbCas13c, FndCas13c, FnfCas13c, FnsCas13c, FpeCas13c, FulCas13c, HheCas13a, LbfCas13a, LbmCas13a, LbnCas13a, LbuCas13a, LseCas13a, LshCas13a, LspCas13a, Lwa2cas13a, LwaCas13a, LweCas13a, PauCas13b, PbuCas13b, PgiCas13b, PguCas13b, Pin2Cas13b, Pin3Cas13b, PinCas13b, Pprcas13a, PsaCas13b, PsmCas13b, RaCas13d, RanCas13b, RcdCas13a, RcrCas13a, RcsCas13a, RfxCas13d, UrCas13d, dPspCas13b, PspCas13b A133H, PspCas13b A1058H, dPspCas13b truncation, dAdmCas13d, dAspCas13b, dAspCas13c, dBmaCas13a, dBzoCas13b, dCamCas13a, dCcaCas13b, dCga2Cas13a, dCgaCas13a, dEbaCas13a, dEreCas13a, dEsCas13d, dFbrCas13b, dFnbCas13c, dFndCas13c, dFnfCas13c, dFnsCas13c, dFpeCas13c, dFulCas13c, dHheCas13a, dLbfCas13a, dLbmCas13a, dLbnCas13a, dLbuCas13a, dLseCas13a, dLshCas13a, dLspCas13a, dLwa2cas13a, dLwaCas13a, dLweCas13a, dPauCas13b, dPbuCas13b, dPgiCas13b, dPguCas13b, dPin2Cas13b, dPin3Cas13b, dPinCas13b, dPprCas13a, dPsaCas13b, dPsmCas13b, dRaCas13d, dRanCas13b, dRcdCas13a, dRcrCas13a, dRcsCas13a, dRfxCas13d, or dUrCas13d. Additional Cas proteins are known in the art (e.g., Konermann et al., Cell, 2018, 173:665-676 e14, Yan et al., Mol Cell, 2018, 7:327-339 e5; Cox, D. B. T., et al., Science, 2017, 358: 1019-1027; Abudayyeh et al., Nature, 2017, 550: 280-284, Gootenberg et al., Science, 2017, 356: 438-442; and East-Seletsky et al., Mol Cell, 2017, 66: 373-383 e3, which are herein incorporated by reference).

In one embodiment, the nucleic acid sequence encoding a Cas protein comprises a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:1-48. In one embodiment, the nucleic acid sequence encoding a Cas protein comprises a nucleic acid sequence encoding an amino acid sequence of a variant of one of SEQ ID NOs:1-48, wherein the variant renders the Cas protein catalytically inactive. the nucleic acid sequence encoding a Cas protein comprises a nucleic acid sequence encoding an amino acid sequence of one of SEQ ID NOs:1-46 having one or more insertions, deletions or substitutions, wherein the one or more insertions, deletions or substitutions renders the Cas protein catalytically inactive. the nucleic acid sequence encoding a Cas protein comprises a nucleic acid sequence encoding an amino acid sequence of one of SEQ ID NOs:1-48 the nucleic acid sequence encoding a Cas protein comprises a nucleic acid sequence encoding an amino acid sequence of one of SEQ ID NOs:47-48.

In one embodiment, the nucleic acid sequence encoding a Cas protein comprises a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 705-708. In one embodiment, the nucleic acid sequence encoding a Cas protein comprises a nucleic acid sequence of one of SEQ ID NOs:705-708. In one embodiment, the nucleic acid sequence encoding a Cas protein comprises a nucleic acid sequence of one of SEQ ID NOs:707-708.

In one embodiment, the NLS is a retrotransposon NLS. In one embodiment, the NLS is derived from Ty1, yeast GAL4, SKI3, L29 or histone H2B proteins, polyoma virus large T protein, VP1 or VP2 capsid protein, SV40 VP1 or VP2 capsid protein, Adenovirus E1 a or DBP protein, influenza virus NS1 protein, hepatitis vims core antigen or the mammalian lamin, c-myc, max, c-myb, p53, c-erbA, jun, Tax, steroid receptor or Mx proteins, Nucleoplasmin (NPM2), Nucleophosmin (NPM1), or simian vims 40 ("SV40") T-antigen.

In one embodiment, the NLS is a Ty1 or Ty1-derived NLS, a Ty2 or Ty2-derived NLS or a MAK11 or MAK11-derived NLS. In one embodiment, the Ty1 NLS comprises an amino acid sequence of SEQ ID NO:75. In one embodiment, the Ty2 NLS comprises an amino acid sequence of SEQ ID NO:76. In one embodiment, the MAK11 NLS comprises an amino acid sequence of SEQ ID NO:77.

In one embodiment, the NLS is a Ty1-like NLS. For example, in one embodiment, the Ty1-like NLS comprises KKRX motif. In one embodiment, the Ty1-like NLS comprises KKRX motif at the N-terminal end. In one embodiment, the Ty1-like NLS comprises KKR motif. In one embodiment, the Ty1-like NLS comprises KKR motif at the C-terminal end. In one embodiment, the Ty1-like NLS comprises a KKRX and a KKR motif. In one embodiment, the Ty1-like NLS comprises a KKRX at the N-terminal end and a KKR motif at the C-terminal end. In one embodiment, the Ty1-like NLS comprises at least 20 amino acids. In one embodiment, the Ty1-like NLS comprises between 20 and 40 amino acids. In one embodiment, the Ty1-like NLS comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:83-695. In one embodiment, the NLS comprises a sequence of one of SEQ ID NOs: 83-695, wherein the sequence comprises one or more, two or more, three or more, four or more, five or more, six or more, seven or more, eight or more, nine or more, or ten or more, insertions, deletions or substitutions. In one embodiment, the Ty1-like NLS protein comprises a sequence of one of SEQ ID NOs: 83-695.

In one embodiment, the NLS comprises two copies of the same NLS. For example, in one embodiment, the NLS comprises a multimer of a first Ty1-derived NLS and a second Ty1-derived NLS.

In one embodiment, the nucleic acid sequence encoding a NLS comprises a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:75-695. In one embodiment, the nucleic acid sequence encoding a NLS comprises a nucleic acid sequence encoding an amino acid sequence of one of SEQ ID NOs: 75-695. In one embodiment, the nucleic acid sequence encoding a NLS comprises a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:724. In one embodiment, the nucleic acid sequence encoding a NLS comprises a nucleic acid sequence of SEQ ID NO:724.

In one embodiment, the cleavage and/or polyadenylation protein is an RNA binding protein of the human 3' end processing machinery. In one embodiment, the cleavage and/or polyadenylation protein is CPSF30, WDR33, or NUDT21. In one embodiment, the cleavage and/or polyadenylation protein is NUDT21. In one embodiment, the cleavage and/or polyadenylation protein is NUDT21, a NUDT21 mutation, a NUDT21 dimer, a NUDT21 fusion protein or any combination thereof. In one embodiment, the cleavage and/or polyadenylation protein is human NUDT21, Worm NUDT21, Fly NUDT21, Zebrafish NUDT21, NUDT21_R63S, NUDT21_F103A, or a tandem dimer of NUDT21.

In one embodiment, nucleic acid molecule comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 49-58. In one embodiment, nucleic acid molecule comprises a sequence encoding an amino acid sequence of one of SEQ ID NOs: 49-58.

In one embodiment, nucleic acid molecule comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, 89%, 90%, at least 91%, at least 92%, at least 93%, at least 94%, at least 95%, at least 96%, at least 97%, at least 98%, or at least 99% identical to one of SEQ ID NOs: 51-58. In one embodiment, nucleic acid molecule comprises a sequence encoding an amino acid sequence of one of SEQ ID NOs: 51-58.

In one embodiment, nucleic acid molecule comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 711-717. In one embodiment, nucleic acid molecule comprises a sequence of one of SEQ ID NOs: 711709-717.

In one embodiment, nucleic acid molecule comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 709-717. In one embodiment, nucleic acid molecule comprises a sequence of one of SEQ ID NOs: 709-717.

In one embodiment, the nucleic acid molecule comprises a sequence encoding a tag. In one embodiment, the nucleic acid molecule comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:74. In one embodiment, the nucleic acid molecule comprises a sequence encoding an amino acid sequence of SEQ ID NO: 7474.

In one embodiment, nucleic acid molecule comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:723. In one embodiment, nucleic acid molecule comprises a sequence of SEQ ID NO: 723.

In one embodiment, the nucleic acid molecule comprises a sequence encoding a linker. In one embodiment, the nucleic acid molecule comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 67-73. In one embodiment, the nucleic acid molecule comprises a sequence encoding an amino acid sequence of one of SEQ ID NOs: 67-73.74

In one embodiment, nucleic acid molecule comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:722. In one embodiment, nucleic acid molecule comprises a sequence of SEQ ID NO: 722723.

In one embodiment, the nucleic acid molecule encoding a fusion protein comprises a sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 696-698. In one embodiment, the nucleic acid molecule encoding a fusion protein comprises a sequence encoding an amino acid sequence of one of SEQ ID NOs: 696-698.

In one embodiment, the nucleic acid molecule encoding a fusion protein comprises a sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 725-727. In one embodiment, the nucleic acid molecule encoding a fusion protein comprises a sequence of one of SEQ ID NOs:725-727.

The isolated nucleic acid sequence encoding a fusion protein can be obtained using any of the many recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The isolated nucleic acid may comprise any type of nucleic acid, including, but not limited to DNA and RNA. For example, in one embodiment, the composition comprises an isolated DNA molecule, including for example, an isolated cDNA molecule, encoding a fusion protein of the invention. In one embodiment, the composition comprises an isolated RNA molecule encoding a fusion protein of the invention, or a functional fragment thereof.

The nucleic acid molecules of the present invention can be modified to improve stability in serum or in growth medium for cell cultures. Modifications can be added to enhance stability, functionality, and/or specificity and to minimize immunostimulatory properties of the nucleic acid molecule of the invention. For example, in order to enhance the stability, the 3'-residues may be stabilized against degradation, e.g., they may be selected such that they consist of purine nucleotides, particularly adenosine or guanosine nucleotides. Alternatively, substitution of pyrimidine nucleotides by modified analogues, e.g., substitution of uridine by 2'-deoxythymidine is tolerated and does not affect function of the molecule.

In one embodiment of the present invention the nucleic acid molecule may contain at least one modified nucleotide analogue. For example, the ends may be stabilized by incorporating modified nucleotide analogues.

Non-limiting examples of nucleotide analogues include sugar- and/or backbone-modified ribonucleotides (i.e., include modifications to the phosphate-sugar backbone). For example, the phosphodiester linkages of natural RNA may be modified to include at least one of a nitrogen or sulfur heteroatom. In exemplary backbone-modified ribonucleotides the phosphoester group connecting to adjacent ribonucleotides is replaced by a modified group, e.g., of phosphothioate group. In exemplary sugar-modified ribonucleotides, the 2' OH-group is replaced by a group selected from H, OR, R, halo, SH, SR, $NH_2$, NHR, $NR_2$ or ON, wherein R is $C_1$-$C_6$ alkyl, alkenyl or alkynyl and halo is F, Cl, Br or I.

Other examples of modifications are nucleobase-modified ribonucleotides, i.e., ribonucleotides, containing at least one non-naturally occurring nucleobase instead of a naturally occurring nucleobase. Bases may be modified to block the activity of adenosine deaminase. Exemplary modified nucleobases include, but are not limited to, uridine and/or cytidine modified at the 5-position, e.g., 5-(2-amino)propyl uridine, 5-bromo uridine; adenosine and/or guanosines modified at the 8 position, e.g., 8-bromo guanosine; deaza nucleotides, e.g., 7-deaza-adenosine; O- and N-alkylated nucleotides, e.g., N6-methyl adenosine are suitable. It should be noted that the above modifications may be combined.

In some instances, the nucleic acid molecule comprises at least one of the following chemical modifications: 2'-H, 2'-O-methyl, or 2'-OH modification of one or more nucleotides. In certain embodiments, a nucleic acid molecule of the invention can have enhanced resistance to nucleases. For increased nuclease resistance, a nucleic acid molecule, can include, for example, 2'-modified ribose units and/or phosphorothioate linkages. For example, the 2' hydroxyl group (OH) can be modified or replaced with a number of different "oxy" or "deoxy" substituents. For increased nuclease resistance the nucleic acid molecules of the invention can include 2'-O-methyl, 2'-fluorine, 2'-O-methoxyethyl, 2'-O-aminopropyl, 2'-amino, and/or phosphorothioate linkages. Inclusion of locked nucleic acids (LNA), ethylene nucleic acids (ENA), e.g., 2'-4'-ethylene-bridged nucleic acids, and certain nucleobase modifications such as 2-amino-A, 2-thio (e.g., 2-thio-U), G-clamp modifications, can also increase binding affinity to a target.

In one embodiment, the nucleic acid molecule includes a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). In one embodiment, the nucleic acid molecule includes at least one 2'-O-methyl-modified nucleotide, and in some embodiments, all of the nucleotides of the nucleic acid molecule include a 2'-O-methyl modification.

In certain embodiments, the nucleic acid molecule of the invention has one or more of the following properties:

Nucleic acid agents discussed herein include otherwise unmodified RNA and DNA as well as RNA and DNA that have been modified, e.g., to improve efficacy, and polymers of nucleoside surrogates. Unmodified RNA refers to a molecule in which the components of the nucleic acid, namely sugars, bases, and phosphate moieties, are the same or essentially the same as that which occur in nature, or as occur naturally in the human body. The art has referred to rare or unusual, but naturally occurring, RNAs as modified RNAs, see, e.g., Limbach et al. (Nucleic Acids Res., 1994, 22:2183-2196). Such rare or unusual RNAs, often termed modified RNAs, are typically the result of a post-transcriptional modification and are within the term unmodified RNA as used herein. Modified RNA, as used herein, refers to a molecule in which one or more of the components of the nucleic acid, namely sugars, bases, and phosphate moieties, are different from that which occur in nature, or different from that which occurs in the human body. While they are referred to as "modified RNAs" they will of course, because of the modification, include molecules that are not, strictly speaking, RNAs. Nucleoside surrogates are molecules in which the ribophosphate backbone is replaced with a non-ribophosphate construct that allows the bases to be presented in the correct spatial relationship such that hybridization is substantially similar to what is seen with a ribophosphate backbone, e.g., non-charged mimics of the ribophosphate backbone.

Modifications of the nucleic acid of the invention may be present at one or more of, a phosphate group, a sugar group, backbone, N-terminus, C-terminus, or nucleobase.

The present invention also includes a vector in which the isolated nucleic acid of the present invention is inserted. The art is replete with suitable vectors that are useful in the present invention.

In brief summary, the expression of natural or synthetic nucleic acids encoding a fusion protein of the invention is typically achieved by operably linking a nucleic acid encoding the fusion protein of the invention or portions thereof to a promoter, and incorporating the construct into an expression vector. The vectors to be used are suitable for replication and, optionally, integration in eukaryotic cells. Typical vectors contain transcription and translation terminators, initiation sequences, and promoters useful for regulation of the expression of the desired nucleic acid sequence.

The vectors of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The isolated nucleic acid of the invention can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the vector may be provided to a cell in the form of a viral vector. Viral vector technology is well known in the art and is described, for example, in Sambrook et al. (2012, Molecular Cloning: A Laboratory Manual, Cold Spring Harbor Laboratory, New York), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

Delivery Systems and Methods

In one aspect, the invention relates to the development of novel lentiviral packaging and delivery systems. The lentiviral particle delivers the viral enzymes as proteins. In this fashion, lentiviral enzymes are short lived, thus limiting the potential for off-target editing due to long term expression though the entire life of the cell. The incorporation of editing components, or traditional CRISPR-Cas editing components as proteins in lentiviral particles is advantageous, given that their required activity is only required for a short period of time. Thus, in one embodiment, the invention provides a lentiviral delivery system and methods of delivering the compositions of the invention, editing genetic material, and nucleic acid delivery using lentiviral delivery systems.

In one aspect, the delivery system comprises (1) a packaging plasmid (3) an envelope plasmid, and (4) a VPR plasmid. In one embodiment, the packaging plasmid comprises a nucleic acid sequence encoding a gag-pol polyprotein. In one embodiment, the gag-pol polyprotein comprises catalytically dead integrase. In one embodiment, the gag-pol polyprotein comprises the D116N integrase mutation.

In one embodiment, the envelope plasmid comprises a nucleic acid sequence encoding an envelope protein. In one embodiment, the envelope plasmid comprises a nucleic acid sequence encoding an HIV envelope protein. In one embodiment, the envelope plasmid comprises a nucleic acid sequence encoding a vesicular stomatitis virus g-protein (VSV-g) envelope protein. In one embodiment, the envelope protein can be selected based on the desired cell type.

In one embodiment, the VPR plasmid comprises a nucleic acid sequence encoding a fusion protein comprising VPR, a Cas protein and one or more of an NLS, cleavage and/or polyadenylation protein, and a fluorescent protein. In one embodiment, the VPR plasmid comprises a nucleic acid sequence encoding a fusion protein comprising VPR, a Cas protein and one or more of an NLS, cleavage and/or polyadenylation protein, and a fluorescent protein. In one embodiment, the VPR plasmid comprises a nucleic acid sequence encoding a fusion protein comprising VPR, a Cas protein and one or more of an NLS, cleavage and/or polyadenylation protein, and a fluorescent protein. In one embodiment, the fusion protein comprises a protease cleavage site between VPR and the Cas protein NLS, cleavage and/or polyadenylation protein, or a fluorescent protein. In one embodiment, the VPR plasmid packaging plasmid further comprises a sequence encoding a guide RNA sequence.

In one embodiment, the packaging plasmid, transfer plasmid, envelope plasmid, and VPR plasmid are introduced into a cell. In one embodiment, the cell transcribes and translates the nucleic acid sequence encoding the gag-pol protein to produce the gag-pol polyprotein. In one embodiment, the cell transcribes and translates the nucleic acid sequence encoding the envelope protein to produce the envelope protein. In one embodiment, the cell transcribes and translates the fusion protein to produce the VPR-fusion protein. In one embodiment, the cell transcribes and translates the fusion protein to produce the VPR-fusion protein. In one embodiment, the cell transcribes the nucleic acid sequence encoding the guide RNA.

In one embodiment, the gag-pol protein, envelope polyprotein, and VPR-fusion protein, which is bound to the guide RNA, are packaged into a viral particle. In one embodiment, the viral particles are collected from the cell media. In one embodiment, VPR is cleaved from the fusion protein in the viral particle via the protease site to provide a Cas-fusion protein. In one embodiment, the viral particles transduce a target cell, wherein the guide RNA binds a target region of an RNA thereby targeting the Cas fusion protein.

Further, a number of additional viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

For example, vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

In one embodiment, the composition includes a vector derived from an adeno-associated virus (AAV). The term "AAV vector" means a vector derived from an adeno-associated virus serotype, including without limitation, AAV-1, AAV-2, AAV-3, AAV-4, AAV-5, AAV-6, AAV-7, AAV-8, and AAV-9. AAV vectors have become powerful gene delivery tools for the treatment of various disorders. AAV vectors possess a number of features that render them ideally suited for gene therapy, including a lack of pathogenicity, minimal immunogenicity, and the ability to transduce postmitotic cells in a stable and efficient manner. Expression of a particular gene contained within an AAV vector can be specifically targeted to one or more types of cells by choosing the appropriate combination of AAV serotype, promoter, and delivery method.

AAV vectors can have one or more of the AAV wild-type genes deleted in whole or part, preferably the rep and/or cap genes, but retain functional flanking ITR sequences. Despite the high degree of homology, the different serotypes have tropisms for different tissues. The receptor for AAV1 is unknown; however, AAV1 is known to transduce skeletal and cardiac muscle more efficiently than AAV2. Since most of the studies have been done with pseudotyped vectors in which the vector DNA flanked with AAV2 ITR is packaged into capsids of alternate serotypes, it is clear that the biological differences are related to the capsid rather than to the genomes. Recent evidence indicates that DNA expression cassettes packaged in AAV 1 capsids are at least 1 log 10 more efficient at transducing cardiomyocytes than those packaged in AAV2 capsids. In one embodiment, the viral delivery system is an adeno-associated viral delivery system. The adeno-associated virus can be of serotype 1 (AAV 1), serotype 2 (AAV2), serotype 3 (AAV3), serotype 4 (AAV4), serotype 5 (AAV5), serotype 6 (AAV6), serotype 7 (AAV7), serotype 8 (AAV8), or serotype 9 (AAV9).

Desirable AAV fragments for assembly into vectors include the cap proteins, including the vp1, vp2, vp3 and hypervariable regions, the rep proteins, including rep 78, rep 68, rep 52, and rep 40, and the sequences encoding these proteins. These fragments may be readily utilized in a variety of vector systems and host cells. Such fragments may be used alone, in combination with other AAV serotype sequences or fragments, or in combination with elements from other AAV or non-AAV viral sequences. As used herein, artificial AAV serotypes include, without limitation, AAV with a non-naturally occurring capsid protein. Such an artificial capsid may be generated by any suitable technique, using a selected AAV sequence (e.g., a fragment of a vp1 capsid protein) in combination with heterologous sequences which may be obtained from a different selected AAV serotype, non-contiguous portions of the same AAV serotype, from a non-AAV viral source, or from a non-viral source. An artificial AAV serotype may be, without limitation, a chimeric AAV capsid, a recombinant AAV capsid, or a "humanized" AAV capsid. Thus exemplary AAVs, or artificial AAVs, suitable for expression of one or more proteins, include AAV2/8 (see U.S. Pat. No. 7,282,199), AAV2/5 (available from the National Institutes of Health), AAV2/9 (International Patent Publication No. WO2005/033321), AAV2/6 (U.S. Pat. No. 6,156,303), and AAVrh8 (International Patent Publication No. WO2003/042397), among others.

In certain embodiments, the vector also includes conventional control elements which are operably linked to the transgene in a manner which permits its transcription, translation and/or expression in a cell transfected with the plasmid vector or infected with the virus produced by the invention. As used herein, "operably linked" sequences include both expression control sequences that are contiguous with the gene of interest and expression control sequences that act in trans or at a distance to control the gene of interest. Expression control sequences include appropriate transcription initiation, termination, promoter and enhancer sequences; efficient RNA processing signals such as splicing and polyadenylation (polyA) signals; sequences that stabilize cytoplasmic mRNA; sequences that enhance translation efficiency (i.e., Kozak consensus sequence); sequences that enhance protein stability; and when desired, sequences that enhance secretion of the encoded product. A great number of expression control sequences, including promoters which are native, constitutive, inducible and/or tissue-specific, are known in the art and may be utilized.

Additional promoter elements, e.g., enhancers, regulate the frequency of transcriptional initiation. Typically, these are located in the region 30-110 bp upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1α (EF-1α). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Enhancer sequences found on a vector also regulates expression of the gene contained therein. Typically, enhancers are bound with protein factors to enhance the transcription of a gene. Enhancers may be located upstream or downstream of the gene it regulates. Enhancers may also be tissue-specific to enhance transcription in a specific cell or tissue type. In one embodiment, the vector of the present invention comprises one or more enhancers to boost transcription of the gene present within the vector.

In order to assess the expression of a fusion protein of the invention, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al. (2012, Molecular Cloning: A Laboratory Manual, Cold Spring Harbor Laboratory, New York). An exemplary method for the introduction of a polynucleotide into a host cell is calcium phosphate transfection.

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, MO; dicetyl phosphate ("DCP") can be obtained from K & K Laboratories (Plainview, NY); cholesterol ("Chol") can be obtained from Calbiochem-Behring; dimyristyl phosphatidylglycerol ("DMPG") and other lipids may be obtained from Avanti Polar Lipids, Inc. (Birmingham, AL). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Systems

In one aspect, the present invention provides a system for modulating the cleavage, polyadenylation or both of an RNA transcript. In one embodiment the system comprises, in one or more vectors, a nucleic acid sequence encoding a fusion protein, wherein the fusion protein comprises a CRISPR-associated (Cas) protein, a cleavage and/or polyadenylation protein, and a nuclear localization signal (NLS); and a nucleic acid sequence coding a CRISPR-Cas system crRNA. In one embodiment, the CRISPR-Cas system crRNA substantially hybridizes to a target RNA sequence in the RNA transcript. In one embodiment, the nucleic acid sequence encoding the fusion protein and the nucleic acid sequence coding a CRISPR-Cas system crRNA are in the same vector. In one embodiment, the nucleic acid sequence encoding the fusion protein and the nucleic acid sequence coding a CRISPR-Cas system crRNA are in different vectors.

In one embodiment, the nucleic acid sequence encoding a fusion protein comprises (1) a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 1-46; (2) a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, 90%, at least 91%, at least 92%, at least 93%, at least 94%, at least 95%, at least 96%, at least 97%, at least 98%, or at least 99% identical to one of SEQ ID NOs: 51-58; and (3) a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 75-695. In one embodiment, the nucleic acid sequence encoding a fusion protein comprises nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 696-698. In one embodiment, the nucleic acid sequence encoding a fusion protein comprises (1) nucleic acid sequence encoding an amino acid of one of SEQ ID NOs:1-48; (2) nucleic acid sequence encoding an amino acid of one of SEQ ID NOs: 51-58; and (3) nucleic acid sequence encoding an amino acid of one of SEQ ID NOs: 75-695. In one embodiment, the nucleic acid sequence encoding a fusion protein comprises nucleic acid sequence encoding an amino acid of one of SEQ ID NOs: 696-698.

In one aspect, the present invention provides a system for decreasing the number of an RNA transcript in a subject. In one embodiment the system comprises, in one or more vectors, a nucleic acid sequence encoding a fusion protein, wherein the fusion protein comprises a CRISPR-associated (Cas) protein and a nuclear localization signal (NLS); and a nucleic acid sequence coding a CRISPR-Cas system crRNA. In one embodiment, the CRISPR-Cas system crRNA substantially hybridizes to a target RNA sequence in the RNA transcript. In one embodiment, the nucleic acid sequence encoding the fusion protein and the nucleic acid sequence coding a CRISPR-Cas system crRNA are in the same vector. In one embodiment, the nucleic acid sequence encoding the fusion protein and the nucleic acid sequence coding a CRISPR-Cas system crRNA are in different vectors.

In one embodiment, the nucleic acid sequence encoding a fusion protein comprises (1) a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 1-46; and (2) a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 75-695. In one embodiment, the nucleic acid sequence encoding a fusion protein comprises nucleic acid sequence encoding an amino acid at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO: 702. In one embodiment, the nucleic acid sequence encoding a fusion protein comprises (1) nucleic acid sequence encoding an amino acid of one of SEQ ID NOs:1-48; and (2) nucleic acid sequence encoding an amino acid of one of SEQ ID NOs: 75-695. In one embodiment, the nucleic acid sequence encoding a fusion protein comprises nucleic acid sequence encoding an amino acid of SEQ ID NO: 702.

In one aspect, the present invention provides a system for visualizing nuclear RNA in a subject. In one embodiment the system comprises, in one or more vectors, a nucleic acid sequence encoding a fusion protein, wherein the fusion protein comprises a CRISPR-associated (Cas) protein, a fluorescent protein, and a nuclear localization signal (NLS); and a nucleic acid sequence coding a CRISPR-Cas system crRNA. In one embodiment, the CRISPR-Cas system crRNA substantially hybridizes to a target RNA sequence in the RNA transcript. In one embodiment, the nucleic acid sequence encoding the fusion protein and the nucleic acid sequence coding a CRISPR-Cas system crRNA are in the same vector. In one embodiment, the nucleic acid sequence encoding the fusion protein and the nucleic acid sequence coding a CRISPR-Cas system crRNA are in different vectors.

In one embodiment, the nucleic acid sequence encoding a fusion protein comprises (1) a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 1-46; (2) a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 59-66; and (3) a nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 699-701. nucleic acid sequence encoding an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of In one embodiment, the nucleic acid sequence encoding a fusion protein comprises (1) nucleic acid sequence encoding an amino acid of one of SEQ ID NOs:1-48; (2) nucleic acid sequence encoding an amino acid of one of SEQ ID NOs: 59-66; and (3) nucleic acid sequence encoding an amino acid of one of SEQ ID NOs: 75-695. In one embodiment, the nucleic acid sequence encoding a fusion protein comprises nucleic acid sequence encoding an amino acid of one of SEQ ID NOs: 699-701.

The systems and vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector systems can be transcribed and translated in vitro, for example using T7 promoter regulatory sequences and T7 polymerase.

Vectors may be introduced and propagated in a prokaryote. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A. respectively, to the target recombinant protein.

Examples of suitable inducible non-fusion *E. coli* expression vectors include pTrc (Amrann et al., (1988) *Gene* 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector. Examples of vectors for expression in yeast *Saccharomyces cerivisae* include pYepSec1 (Baldari, et al., 1987. *EMBO J.* 6: 229-234), pMFa (Kuijan and Herskowitz, 1982. *Cell* 30: 933-943), pJRY88 (Schultz et al., 1987. *Gene* 54: 113-123), pYES2 (Invitrogen Corporation, San Diego, Calif.), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Lucklow and Summers, 1989. *Virology* 170: 31-39).

In some embodiments, a vector is capable of driving expression of one or more sequences in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science*

249: 374-379) and the α-fetoprotein promoter (Campes and Tilghman, 1989. *Genes Dev.* 3: 537-546).

In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli*(Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to *Aeropyrum, Pyrobaculum, Sulfolobus, Archaeoglobus, Halocarcula, Methanobacteriumn, Methanococcus, Methanosarcina, Methanopyrus, Pyrococcus, Picrophilus, Thernioplasnia, Corynebacterium, Mycobacterium, Streptomyces, Aquifrx, Porphvromonas, Chlorobium, Thermus, Bacillus, Listeria, Staphylococcus, Clostridium, Thermoanaerobacter, Mycoplasma, Fusobacterium, Azarcus, Chromobacterium, Neisseria, Nitrosomonas, Desulfovibrio, Geobacter, Myrococcus, Campylobacter, Wolinella, Acinetobacter, Erwinia, Escherichia, Legionella, Methylococcus, Pasteurella, Photobacterium, Salmonella, Xanthomonas, Yersinia, Treponema*, and *Thermotoga*.

As used herein, a "target sequence" refers to a sequence to which a crRNA sequence is designed to have complementarity, where hybridization between a target sequence and a guide sequence promotes the formation of a CRISPR complex. Full complementarity is not necessarily required, provided there is sufficient complementarity to cause hybridization and promote formation of a CRISPR complex. A target sequence may comprise any polynucleotide, such as DNA or RNA polynucleotides. In some embodiments, a target sequence is located in the nucleus or cytoplasm of a cell. In some embodiments, the target sequence may be within an organelle of a eukaryotic cell, for example, mitochondrion or chloroplast.

The ability of a crRNA to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A crRNA sequence, and hence a nucleic acid-targeting crRNA may be selected to target any target nucleic acid sequence.

The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, *Cell* 106(1): 23-24; and PA Carr and GM Church, 2009, *Nature Biotechnology* 27(12): 1151-62).

In some embodiments, a crRNA is selected to reduce the degree secondary structure within the nucleic acid-targeting guide. In some embodiments, about or less than about 75%, 50%, 40%, 30%, 25%, 20%, 15%, 10%, 5%, 1%, or fewer of the nucleotides of the nucleic acid-targeting guide participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In certain embodiments, a crRNA may comprise, consist essentially of, or consist of a direct repeat (DR) sequence and a guide sequence or spacer sequence. In certain embodiments, the crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop. In one embodiment, the crRNA comprises a single stem loop. In certain embodiments, the direct repeat sequence forms a stem loop. In one embodiment, the direct repeat sequence forms a single stem loop.

In one embodiment, the crRNA enhances the activity of Cas13 targeting to a target sequence, Cas13 catalytic activity, or both. For example, in one embodiment, the crRNA the crRNA sequence comprises a mutation in its direct repeat sequence. For example, in one embodiment, the crRNA comprises a T17C point mutation. In one embodiment, the crRNA comprises a T18C point mutation.

Pharmaceutical Compositions and Formulations

The invention also encompasses the use of pharmaceutical compositions of the invention or salts thereof to practice the methods of the invention. Such a pharmaceutical composition may consist of at least one modulator (e.g., inhibitor or activator) composition of the invention or a salt thereof in a form suitable for administration to a subject, or the pharmaceutical composition may comprise at least one modulator (e.g., inhibitor or activator) composition of the invention or a salt thereof, and one or more pharmaceutically acceptable carriers, one or more additional ingredients, or some combination of these. The compound of the invention may be present in the pharmaceutical composition in the form of a physiologically acceptable salt, such as in combination with a physiologically acceptable cation or anion, as is well known in the art.

In an embodiment, the pharmaceutical compositions useful for practicing the methods of the invention may be administered to deliver a dose of between 1 ng/kg/day and 100 mg/kg/day. In another embodiment, the pharmaceutical compositions useful for practicing the invention may be administered to deliver a dose of between 1 ng/kg/day and 500 mg/kg/day.

The relative amounts of the active ingredient, the pharmaceutically acceptable carrier, and any additional ingredients in a pharmaceutical composition of the invention will vary, depending upon the identity, size, and condition of the subject treated and further depending upon the route by which the composition is to be administered. By way of example, the composition may comprise between 0.1% and 100% (w/w) active ingredient.

Pharmaceutical compositions that are useful in the methods of the invention may be suitably developed for oral, rectal, vaginal, parenteral, topical, pulmonary, intranasal, buccal, ophthalmic, or another route of administration. A composition useful within the methods of the invention may be directly administered to the skin, or any other tissue of a mammal. Other contemplated formulations include liposomal preparations, resealed erythrocytes containing the active ingredient, and immunologically-based formulations. The route(s) of administration will be readily apparent to the skilled artisan and will depend upon any number of factors including the type and severity of the disease being treated, the type and age of the veterinary or human subject being treated, and the like.

The formulations of the pharmaceutical compositions described herein may be prepared by any method known or hereafter developed in the art of pharmacology. In general, such preparatory methods include the step of bringing the active ingredient into association with a carrier or one or more other accessory ingredients, and then, if necessary or desirable, shaping or packaging the product into a desired single- or multi-dose unit.

As used herein, a "unit dose" is a discrete amount of the pharmaceutical composition comprising a predetermined amount of the active ingredient. The amount of the active ingredient is generally equal to the dosage of the active ingredient that would be administered to a subject or a convenient fraction of such a dosage such as, for example, one-half or one-third of such a dosage. The unit dosage form may be for a single daily dose or one of multiple daily doses (e.g., about 1 to 4 or more times per day). When multiple daily doses are used, the unit dosage form may be the same or different for each dose.

In one embodiment, the compositions of the invention are formulated using one or more pharmaceutically acceptable excipients or carriers. In one embodiment, the pharmaceutical compositions of the invention comprise a therapeutically effective amount of a compound or conjugate of the invention and a pharmaceutically acceptable carrier. Pharmaceutically acceptable carriers that are useful, include, but are not limited to, glycerol, water, saline, ethanol and other pharmaceutically acceptable salt solutions such as phosphates and salts of organic acids. Examples of these and other pharmaceutically acceptable carriers are described in Remington's Pharmaceutical Sciences (1991, Mack Publication Co., New Jersey).

The carrier may be a solvent or dispersion medium containing, for example, water, ethanol, polyol (for example, glycerol, propylene glycol, and liquid polyethylene glycol, and the like), suitable mixtures thereof, and vegetable oils. The proper fluidity may be maintained, for example, by the use of a coating such as lecithin, by the maintenance of the required particle size in the case of dispersion and by the use of surfactants. Prevention of the action of microorganisms may be achieved by various antibacterial and antifungal agents, for example, parabens, chlorobutanol, phenol, ascorbic acid, thimerosal, and the like. In many cases, isotonic agents, for example, sugars, sodium chloride, or polyalcohols such as mannitol and sorbitol are included in the composition. Prolonged absorption of the injectable compositions may be brought about by including in the composition an agent that delays absorption, for example, aluminum monostearate or gelatin. In one embodiment, the pharmaceutically acceptable carrier is not DMSO alone.

Formulations may be employed in admixtures with conventional excipients, i.e., pharmaceutically acceptable organic or inorganic carrier substances suitable for oral, vaginal, parenteral, nasal, intravenous, subcutaneous, enteral, or any other suitable mode of administration, known to the art. The pharmaceutical preparations may be sterilized and if desired mixed with auxiliary agents, e.g., lubricants, preservatives, stabilizers, wetting agents, emulsifiers, salts for influencing osmotic pressure buffers, coloring, flavoring and/or aromatic substances and the like. They may also be combined where desired with other active agents, e.g., other analgesic agents.

As used herein, "additional ingredients" include, but are not limited to, one or more of the following: excipients; surface active agents; dispersing agents; inert diluents; granulating and disintegrating agents; binding agents; lubricating agents; sweetening agents; flavoring agents; coloring agents; preservatives; physiologically degradable compositions such as gelatin; aqueous vehicles and solvents; oily vehicles and solvents; suspending agents; dispersing or wetting agents; emulsifying agents, demulcents; buffers;

salts; thickening agents; fillers; emulsifying agents; antioxidants; antibiotics; antifungal agents; stabilizing agents; and pharmaceutically acceptable polymeric or hydrophobic materials. Other "additional ingredients" that may be included in the pharmaceutical compositions of the invention are known in the art and described, for example in Genaro, ed. (1985, Remington's Pharmaceutical Sciences, Mack Publishing Co., Easton, PA), which is incorporated herein by reference.

The composition of the invention may comprise a preservative from about 0.005% to 2.0% by total weight of the composition. The preservative is used to prevent spoilage in the case of exposure to contaminants in the environment. Examples of preservatives useful in accordance with the invention included but are not limited to those selected from the group consisting of benzyl alcohol, sorbic acid, parabens, imidurea and combinations thereof. An exemplary preservative is a combination of about 0.5% to 2.0% benzyl alcohol and 0.05% to 0.5% sorbic acid.

In one embodiment, the composition includes an antioxidant and a chelating agent that inhibits the degradation of the compound. Exemplary antioxidants for some compounds are BHT, BHA, alpha-tocopherol and ascorbic acid in the range of about 0.01% to 0.3% and BHT in the range of 0.03% to 0.1% by weight by total weight of the composition. In one embodiment, the chelating agent is present in an amount of from 0.01% to 0.5% by weight by total weight of the composition. Exemplary chelating agents include edetate salts (e.g. disodium edetate) and citric acid in the weight range of about 0.01% to 0.20%. In some embodiments, the chelating agent is in the range of 0.02% to 0.10% by weight by total weight of the composition. The chelating agent is useful for chelating metal ions in the composition that may be detrimental to the shelf life of the formulation. While BHT and disodium edetate are exemplary antioxidants and chelating agent respectively for some compounds, other suitable and equivalent antioxidants and chelating agents may be substituted therefore as would be known to those skilled in the art.

Liquid suspensions may be prepared using conventional methods to achieve suspension of the active ingredient in an aqueous or oily vehicle. Aqueous vehicles include, for example, water, and isotonic saline. Oily vehicles include, for example, almond oil, oily esters, ethyl alcohol, vegetable oils such as arachis, olive, sesame, or coconut oil, fractionated vegetable oils, and mineral oils such as liquid paraffin. Liquid suspensions may further comprise one or more additional ingredients including, but not limited to, suspending agents, dispersing or wetting agents, emulsifying agents, demulcents, preservatives, buffers, salts, flavorings, coloring agents, and sweetening agents. Oily suspensions may further comprise a thickening agent. Known suspending agents include, but are not limited to, sorbitol syrup, hydrogenated edible fats, sodium alginate, polyvinylpyrrolidone, gum tragacanth, gum acacia, and cellulose derivatives such as sodium carboxymethylcellulose, methylcellulose, hydroxypropylmethylcellulose. Known dispersing or wetting agents include, but are not limited to, naturally-occurring phosphatides such as lecithin, condensation products of an alkylene oxide with a fatty acid, with a long chain aliphatic alcohol, with a partial ester derived from a fatty acid and a hexitol, or with a partial ester derived from a fatty acid and a hexitol anhydride (e.g., polyoxyethylene stearate, heptadecaethyleneoxycetanol, polyoxyethylene sorbitol monooleate, and polyoxyethylene sorbitan monooleate, respectively). Known emulsifying agents include, but are not limited to, lecithin, and acacia. Known preservatives include, but are not limited to, methyl, ethyl, or n-propyl-para-hydroxybenzoates, ascorbic acid, and sorbic acid. Known sweetening agents include, for example, glycerol, propylene glycol, sorbitol, sucrose, and saccharin. Known thickening agents for oily suspensions include, for example, beeswax, hard paraffin, and cetyl alcohol.

Liquid solutions of the active ingredient in aqueous or oily solvents may be prepared in substantially the same manner as liquid suspensions, the primary difference being that the active ingredient is dissolved, rather than suspended in the solvent. As used herein, an "oily" liquid is one which comprises a carbon-containing liquid molecule and which exhibits a less polar character than water. Liquid solutions of the pharmaceutical composition of the invention may comprise each of the components described with regard to liquid suspensions, it being understood that suspending agents will not necessarily aid dissolution of the active ingredient in the solvent. Aqueous solvents include, for example, water, and isotonic saline. Oily solvents include, for example, almond oil, oily esters, ethyl alcohol, vegetable oils such as arachis, olive, sesame, or coconut oil, fractionated vegetable oils, and mineral oils such as liquid paraffin.

Powdered and granular formulations of a pharmaceutical preparation of the invention may be prepared using known methods. Such formulations may be administered directly to a subject, used, for example, to form tablets, to fill capsules, or to prepare an aqueous or oily suspension or solution by addition of an aqueous or oily vehicle thereto. Each of these formulations may further comprise one or more of dispersing or wetting agent, a suspending agent, and a preservative. Additional excipients, such as fillers and sweetening, flavoring, or coloring agents, may also be included in these formulations.

A pharmaceutical composition of the invention may also be prepared, packaged, or sold in the form of oil-in-water emulsion or a water-in-oil emulsion. The oily phase may be a vegetable oil such as olive or arachis oil, a mineral oil such as liquid paraffin, or a combination of these. Such compositions may further comprise one or more emulsifying agents such as naturally occurring gums such as gum acacia or gum tragacanth, naturally-occurring phosphatides such as soybean or lecithin phosphatide, esters or partial esters derived from combinations of fatty acids and hexitol anhydrides such as sorbitan monooleate, and condensation products of such partial esters with ethylene oxide such as polyoxyethylene sorbitan monooleate. These emulsions may also contain additional ingredients including, for example, sweetening or flavoring agents.

Methods for impregnating or coating a material with a chemical composition are known in the art, and include, but are not limited to methods of depositing or binding a chemical composition onto a surface, methods of incorporating a chemical composition into the structure of a material during the synthesis of the material (i.e., such as with a physiologically degradable material), and methods of absorbing an aqueous or oily solution or suspension into an absorbent material, with or without subsequent drying.

The regimen of administration may affect what constitutes an effective amount. The therapeutic formulations may be administered to the subject either prior to or after a diagnosis of disease. Further, several divided dosages, as well as staggered dosages may be administered daily or sequentially, or the dose may be continuously infused, or may be a bolus injection. Further, the dosages of the therapeutic formulations may be proportionally increased or decreased as indicated by the exigencies of the therapeutic or prophylactic situation.

Administration of the compositions of the present invention to a subject, include a mammal, for example a human, may be carried out using known procedures, at dosages and for periods of time effective to prevent or treat disease. An effective amount of the therapeutic compound necessary to achieve a therapeutic effect may vary according to factors such as the activity of the particular compound employed; the time of administration; the rate of excretion of the compound; the duration of the treatment; other drugs, compounds or materials used in combination with the compound; the state of the disease or disorder, age, sex, weight, condition, general health and prior medical history of the subject being treated, and like factors well-known in the medical arts. Dosage regimens may be adjusted to provide the optimum therapeutic response. For example, several divided doses may be administered daily or the dose may be proportionally reduced as indicated by the exigencies of the therapeutic situation. A non-limiting example of an effective dose range for a therapeutic compound of the invention is from about 1 and 5,000 mg/kg of body weight/per day. One of ordinary skill in the art would be able to study the relevant factors and make the determination regarding the effective amount of the therapeutic compound without undue experimentation.

The compound may be administered to a subject as frequently as several times daily, or it may be administered less frequently, such as once a day, once a week, once every two weeks, once a month, or even less frequently, such as once every several months or even once a year or less. It is understood that the amount of compound dosed per day may be administered, in non-limiting examples, every day, every other day, every 2 days, every 3 days, every 4 days, or every 5 days. For example, with every other day administration, a 5 mg per day dose may be initiated on Monday with a first subsequent 5 mg per day dose administered on Wednesday, a second subsequent 5 mg per day dose administered on Friday, and so on. The frequency of the dose will be readily apparent to the skilled artisan and will depend upon any number of factors, such as, but not limited to, the type and severity of the disease being treated, the type and age of the animal, etc.

Actual dosage levels of the active ingredients in the pharmaceutical compositions of this invention may be varied so as to obtain an amount of the active ingredient that is effective to achieve the desired therapeutic response for a particular subject, composition, and mode of administration, without being toxic to the subject.

A medical doctor, e.g., physician or veterinarian, having ordinary skill in the art may readily determine and prescribe the effective amount of the pharmaceutical composition required. For example, the physician or veterinarian could start doses of the compounds of the invention employed in the pharmaceutical composition at levels lower than that required in order to achieve the desired therapeutic effect and gradually increase the dosage until the desired effect is achieved.

In particular embodiments, it is especially advantageous to formulate the compound in dosage unit form for ease of administration and uniformity of dosage. Dosage unit form as used herein refers to physically discrete units suited as unitary dosages for the subjects to be treated; each unit containing a predetermined quantity of therapeutic compound calculated to produce the desired therapeutic effect in association with the required pharmaceutical vehicle. The dosage unit forms of the invention are dictated by and directly dependent on (a) the unique characteristics of the therapeutic compound and the particular therapeutic effect to be achieved, and (b) the limitations inherent in the art of compounding/formulating such a therapeutic compound for the treatment of a disease in a subject.

In one embodiment, the compositions of the invention are administered to the subject in dosages that range from one to five times per day or more. In another embodiment, the compositions of the invention are administered to the subject in range of dosages that include, but are not limited to, once every day, every two, days, every three days to once a week, and once every two weeks. It will be readily apparent to one skilled in the art that the frequency of administration of the various combination compositions of the invention will vary from subject to subject depending on many factors including, but not limited to, age, disease or disorder to be treated, gender, overall health, and other factors. Thus, the invention should not be construed to be limited to any particular dosage regime and the precise dosage and composition to be administered to any subject will be determined by the attending physical taking all other factors about the subject into account.

Compounds of the invention for administration may be in the range of from about 1 mg to about 10,000 mg, about 20 mg to about 9,500 mg, about 40 mg to about 9,000 mg, about 75 mg to about 8,500 mg, about 150 mg to about 7,500 mg, about 200 mg to about 7,000 mg, about 3050 mg to about 6,000 mg, about 500 mg to about 5,000 mg, about 750 mg to about 4,000 mg, about 1 mg to about 3,000 mg, about 10 mg to about 2,500 mg, about 20 mg to about 2,000 mg, about 25 mg to about 1,500 mg, about 50 mg to about 1,000 mg, about 75 mg to about 900 mg, about 100 mg to about 800 mg, about 250 mg to about 750 mg, about 300 mg to about 600 mg, about 400 mg to about 500 mg, and any and all whole or partial increments there between.

In some embodiments, the dose of a compound of the invention is from about 1 mg and about 2,500 mg. In some embodiments, a dose of a compound of the invention used in compositions described herein is less than about 10,000 mg, or less than about 8,000 mg, or less than about 6,000 mg, or less than about 5,000 mg, or less than about 3,000 mg, or less than about 2,000 mg, or less than about 1,000 mg, or less than about 500 mg, or less than about 200 mg, or less than about 50 mg. Similarly, in some embodiments, a dose of a second compound (i.e., a drug used for treating the same or another disease as that treated by the compositions of the invention) as described herein is less than about 1,000 mg, or less than about 800 mg, or less than about 600 mg, or less than about 500 mg, or less than about 400 mg, or less than about 300 mg, or less than about 200 mg, or less than about 100 mg, or less than about 50 mg, or less than about 40 mg, or less than about 30 mg, or less than about 25 mg, or less than about 20 mg, or less than about 15 mg, or less than about 10 mg, or less than about 5 mg, or less than about 2 mg, or less than about 1 mg, or less than about 0.5 mg, and any and all whole or partial increments thereof.

In one embodiment, the present invention is directed to a packaged pharmaceutical composition comprising a container holding a therapeutically effective amount of a compound or conjugate of the invention, alone or in combination with a second pharmaceutical agent; and instructions for using the compound or conjugate to treat, prevent, or reduce one or more symptoms of a disease in a subject.

The term "container" includes any receptacle for holding the pharmaceutical composition. For example, in one embodiment, the container is the packaging that contains the pharmaceutical composition. In other embodiments, the container is not the packaging that contains the pharmaceutical composition, i.e., the container is a receptacle, such as a box or vial that contains the packaged pharmaceutical composition or unpackaged pharmaceutical composition and the instructions for use of the pharmaceutical composition. Moreover, packaging techniques are well known in the art. It should be understood that the instructions for use of the pharmaceutical composition may be contained on the packaging containing the pharmaceutical composition, and as such the instructions form an increased functional relationship to the packaged product. However, it should be understood that the instructions may contain information pertaining to the compound's ability to perform its intended function, e.g., treating or preventing a disease in a subject, or delivering an imaging or diagnostic agent to a subject.

Routes of administration of any of the compositions of the invention include oral, nasal, parenteral, sublingual, transdermal, transmucosal (e.g., sublingual, lingual, (trans)buccal, and (intra)nasal), intravesical, intraduodenal, intragastrical, rectal, intra-peritoneal, subcutaneous, intramuscular, intradermal, intra-arterial, intravenous, or administration.

Suitable compositions and dosage forms include, for example, tablets, capsules, caplets, pills, gel caps, troches, dispersions, suspensions, solutions, syrups, granules, beads, transdermal patches, gels, powders, pellets, magmas, lozenges, creams, pastes, plasters, lotions, discs, suppositories, liquid sprays for nasal or oral administration, dry powder or aerosolized formulations for inhalation, compositions and formulations for intravesical administration and the like. It should be understood that the formulations and compositions that would be useful in the present invention are not limited to the particular formulations and compositions that are described herein.

Methods of Modulating RNA Cleavage and/or Polyadenylation & Methods of Treatment In one aspect, the invention provides methods of modulating the cleavage, polyadenylation or both of an RNA transcript in a subject. In one embodiment, the method comprises administering to the subject (1) a nucleic acid molecule encoding a fusion protein of the invention comprising a Cas protein and a cleavage and/or polyadenylation protein or a fusion protein of the invention comprising a Cas protein a cleavage and/or polyadenylation protein, and (2) a nucleic acid molecule encoding a guide nucleic acid molecule comprising a targeting nucleotide sequence complimentary to a target RNA sequence in the RNA transcript or a guide nucleic acid molecule comprising a targeting nucleotide sequence complimentary to a target RNA sequence in the RNA transcript.

In one embodiment, the subject is a cell. In one embodiment, the subject is a mammal. For example, in one embodiment, the subject is a human, non-human primate, dog, cat, horse, cow, goat, sheep, rabbit, pig, rat, or mouse. In one embodiment, the subject is a non-mammalian subject. For example, in one embodiment, the subject is a zebrafish, fruit fly, or roundworm.

In one embodiment, the cleavage, polyadenylation or both of an RNA transcript is modulated in vitro. In one embodiment, the cleavage, polyadenylation or both of an RNA transcript is modulated in vivo.

In one embodiment, the method comprises administering to the subject a nucleic acid molecule comprising a nucleic acid sequence encoding a fusion protein comprising at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 696-698 and a guide nucleic acid comprising a targeting nucleotide sequence complimentary to a target region in a gene, wherein the gene encodes the RNA transcript. In one embodiment, the method comprises administering to the subject a nucleic acid molecule comprising a nucleic acid sequence least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 725-727 and a nucleic acid sequence encoding a guide nucleic acid comprising a targeting nucleotide sequence complimentary to a target region in a gene, wherein the gene encodes the RNA transcript.

In one embodiment, the method comprises administering to the subject a fusion protein comprising an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 696-698 and a guide nucleic acid comprising a targeting nucleotide sequence complimentary to a target region in a gene, wherein the gene encodes the RNA transcript.

In one aspect, the invention provides a method of treating a disease or disorder associated with abnormal cleavage and/or polyadenylation. In one embodiment, the method comprises administering to the subject (1) a nucleic acid molecule encoding a fusion protein of the invention comprising a Cas protein a cleavage and/or polyadenylation protein, and (2) a guide nucleic acid molecule comprising a targeting nucleotide sequence complimentary to a target region in a gene, wherein the gene encodes the RNA transcript.

In one embodiment, the method comprises administering to the subject a (1) a nucleic acid molecule encoding a fusion protein of the invention comprising a Cas protein a cleavage and/or polyadenylation protein and (2) a guide nucleic acid molecule comprising a crRNA targeting nucleotide sequence complimentary to a target region in a gene, wherein the gene encodes the RNA transcript.

In one embodiment, the gene is associated with abnormal 3'UTR lengthening, 3'UTR shortening, polyadenylation signal alteration, or other abnormal polyadenylation which causes the disease or disorder. Exemplary diseases or disorders and corresponding targets include, but are not limited to those listed in Table 1.

For example, in one embodiment, treating a Alzheimer's Disease, wherein the method comprises administering to the subject a (1) a nucleic acid molecule encoding a fusion protein of the invention comprising a Cas protein a cleavage and/or polyadenylation protein and (2) a guide nucleic acid molecule comprising a crRNA targeting nucleotide sequence complimentary to a target region in a gene selected from the group consisting of ABCA3, EIF2B3, MSTO2P, OGDHL, PARP6, SLC33A1, SUPV3L1, TAF3, WASH7P, JAK1, ABCA3, UBR1, ALDOC, C10ord10, GABARAPL2, KAT2A, POLR3A, SH3BGRL2, TIMM23, TMC6, UNC80, and WTAP.

TABLE 1

Diseases or disorders associated with abnormal cleavage and/or polyadenylation and target gene(s).

| Condition | Target | Description |
|---|---|---|
| Alzheimer's disease | ABCA3, EIF2B3, MSTO2P, OGDHL, PARP6, SLC33A1, SUPV3L1, TAF3, WASH7P, JAK1, ABCA3, UBR1, ALDOC, C10orf10, GABARAPL2, KAT2A, POLR3A, SH3BGRL2, TIMM23, TMC6, UNC80, WTAP | 3'UTR lengthening, and/or 3'UTR shortening |
| Amyotrophic Lateral Sclerosis | CCDC92, CRYAB, MAP7D2, PRPH, RTN4, SEC22B, SNAP25, UCHL1, YWHAB, C14orf2, C6orf203, ALDOC, ARL6IP1, CSDE1, CMC2, GAP43, LDHB, MLLT11, NCL, PFN2, TMOD1, VAMP1 | 3'UTR lengthening, and/or 3'UTR shortening |
| B-cell differentiation | IGHM | CSTF2 leads to proximal polyadenylation signal usage |
| Cancer, Colorectal | DMKN, PDXK, PPIE | 3'UTR shortening has occurred during tumorigenesis |
| Cancer, Various | TP53 | Polyadenylation signal alteration (AATAAA to AATGAA); Shortening of 3' untranslated region |
| Chronic lymphocytic leukaemia | Intronic loci | Widespread polyadenylation at intronic loci inactivates tumor suppressor genes |
| Diabetic nephropathy | HGRG-14 | High-glucose level leads to distal polyadenylation signal usage |
| Fragile X Syndrome | FMR1 | Polymorphic CGG repeat resulting in CpG methylation of the DNA in both the promoter region of the FMR1 gene, and of the expanded repeat |
| Friedreich's Ataxia | YSH1 | Missense mutations in Ysh1 of the mRNA cleavage and polyadenylation complex induce $(GAA)_n$ repeat expansions |
| Glioblastoma | CCND1 | Knockdown of CPSF5 induces 3'UTR shortening |
| IPEX Syndrome | FOXP3 | Polyadenylation signal alteration (AATAAA to AATGAA) |
| Myotonic Dystrophy Type I | DMPK | Expansion of a CTG repeat in the 3' untranslated region of the DMPK gene |
| Myotonic Dystrophy Type II | ZFN9 | Expansion of a CCTG repeat in the first intron of ZFN9 |
| Neonatal diabetes | INS | Disruptive alteration in polyadenylation signal |
| Oculopharyngeal muscular dystrophy | PABPN1 | $(GCG)_n$ trinucleotide repeat expansion |
| Parkinson's disease | SNCA | Parkinson's disease risk factor induces shorter isoform |
| Proliferative conditions | RBX1 | Hyper-activated mTOR leads to usage of proximal polyadenylation signals |
| Spinocerebellar Ataxia 1 | ATXN1 | Polyadenylation signal alteration (CAG repeat) |
| Spinocerebellar Ataxia 10 | ATXN10 | Polyadenylation signal alteration (ATTCT repeat) |
| Spinocerebellar Ataxia 17 | TATA-box binding protein | Polyadenylation signal alteration (CAG repeat) |
| Spinocerebellar Ataxia 2 | ATXN2 | Polyadenylation signal alteration (CAG repeat) |
| Spinocerebellar Ataxia 3 | ATXN3 | Polyadenylation signal alteration (CAG repeat) |
| Spinocerebellar Ataxia 31 | BEAN1 | Polyadenylation signal alteration (TGGAA repeat) |
| Spinocerebellar Ataxia 6 | CACNA1A | Polyadenylation signal alteration (CAG repeat) |
| Spinocerebellar Ataxia 7 | TPP1 | Polyadenylation signal alteration (CAG repeat) |
| Spinocerebellar Ataxia 8 | ATXN8OS | Polyadenylation signal alteration (CTG/CAG repeat) |
| Steroidogenesis | STAR | Br-cAMP stimulates distal polyadenylation signal usage |
| Systemic lupus erythematosus | GIMAP5 | Polyadenylation signal alteration (AATAAA to AATAGA) |
| Systemic lupus erythematosus | IRF5 | Polyadenylation signal alteration (AATGAA to AATAAA) |
| T-cell activation | NF-ATC1 | Upregulation of CSTF2 stimulates 3'UTR shortening during T-cells activation |
| Thrombophilia | F2 | CG-to-CA variant |
| Type I diabetes | GIMAP5 | Polyadenylation signal alteration (AATAAA to AATAGA) |
| Type II diabetes | TCF7L2 | Increased different isoforms by usage of intronic polyadenylation signals |
| Wiskott-Aldrich Syndrome | WAS | Locus alteration resulting in expression of 3' isoform of WAS mRNA |
| α-Thalassaemia | HBA1, HBA2 | Polyadenylation signal alteration (AATAAA to AATAAG) |

TABLE 1-continued

Diseases or disorders associated with abnormal cleavage and/or polyadenylation and target gene(s).

| Condition | Target | Description |
|---|---|---|
| β-Thalassaemia | HBB | Polyadenylation signal alteration (AATAAA to AACAAA; AATAAA to A—; AATAAA to AATAAG) |

Methods of Decreasing RNA & Methods of Treatment

In one aspect, the invention provides methods of decreasing the number of a nuclear RNA in a subject. In one embodiment, nuclear RNA is abnormal nuclear RNA. In one embodiment, the method comprises administering to the subject (1) a nucleic acid molecule encoding a fusion protein of the invention comprising a Cas protein and an NLS or a fusion protein of the invention comprising a Cas protein and an NLS, and (2) a nucleic acid molecule encoding a guide nucleic acid molecule comprising a targeting nucleotide sequence complimentary to a target RNA sequence in the nuclear RNA or a guide nucleic acid molecule comprising a targeting nucleotide sequence complimentary to a target RNA sequence in the nuclear RNA.

In one embodiment, the method comprises administering to the subject a nucleic acid molecule comprising a nucleic acid sequence encoding a fusion protein comprising at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:702 and a guide nucleic acid comprising a targeting nucleotide sequence complimentary to a target region in a gene, wherein the gene encodes the RNA transcript. In one embodiment, the method comprises administering to the subject a nucleic acid molecule comprising a nucleic acid sequence least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:731 and a nucleic acid sequence encoding a guide nucleic acid comprising a targeting nucleotide sequence complimentary to a target region in a gene, wherein the gene encodes the RNA transcript.

In one embodiment, the method comprises administering to the subject a fusion protein comprising an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:702 and a guide nucleic acid comprising a targeting nucleotide sequence complimentary to a target region in a gene, wherein the gene encodes the RNA transcript.

In one embodiment, the subject is a cell. In one embodiment, the cell is a prokaryotic cell or eukaryotic cell. In one embodiment, the cell is a eukaryotic cell. In one embodiment, the cell is a plants, animals, or fungi cell. In one embodiment, the cell is a plant cell. In one embodiment, the cell is an animal cell. In one embodiment, the cell is a yeast cell.

In one embodiment, the subject is a mammal. For example, in one embodiment, the subject is a human, non-human primate, dog, cat, horse, cow, goat, sheep, rabbit, pig, rat, or mouse. In one embodiment, the subject is a non-mammalian subject. For example, in one embodiment, the subject is a zebrafish, fruit fly, or roundworm.

In one embodiment, the amount of nuclear RNA is reduced in vitro. In one embodiment, the amount of nuclear RNA is reduced in vivo.

In one embodiment, the nuclear RNA is nuclear RNA foci. In one embodiment, the guide nucleic acid comprises a sequence complementary to a CTG repeat expansion in the 3'UTR of the human dystrophia myotonica-protein kinase (DMPK) gene. In one embodiment, the guide nucleic acid comprises a sequence of one of SEQ ID NOs:762-764.

In one aspect, the present invention provides methods of treating a subject with a disease or disorder associated with abnormal nuclear RNA. In one embodiment, the method comprises administering to the subject (1) a nucleic acid molecule encoding a fusion protein of the invention comprising a Cas protein and an NLS or a fusion protein of the invention comprising a Cas protein and an NLS, and (2) a nucleic acid molecule encoding a guide nucleic acid molecule comprising a targeting nucleotide sequence complimentary to a target RNA sequence in the nuclear RNA or a guide nucleic acid molecule comprising a targeting nucleotide sequence complimentary to a target RNA sequence in the nuclear RNA.

In one embodiment, the disease or disorder associated with abnormal nuclear RNA is selected from the group consisting of Myotonic Dystrophy type 2 (DM2), Amyotrophic lateral sclerosis (ALS), Huntington's disease-like 2 (HDL2), Spinocerebellar ataxias 8, 31 and 10 (SCAB, -31, -10) and fragile X-associated tremor ataxia syndrome (FX-TAS).

In one embodiment, the abnormal nuclear RNA is toxic nuclear RNA foci. In one embodiment, the disease or disorder associated with toxic nuclear RNA foci Myotonic Dystrophy type 1. In one embodiment, the targeting nucleotide sequence comprises a sequence complementary to a CTG repeat expansion in the 3'UTR of the human dystrophia myotonica-protein kinase (DMPK) gene. In one embodiment, the targeting nucleotide sequence comprises a sequence selected from the group consisting of SEQ ID NOs:762-764.

In one aspect, the present invention provides methods cleaving of nuclear RNA in a subject. In one embodiment, the method comprises administering to the subject (1) a nucleic acid molecule encoding a fusion protein of the invention comprising a Cas protein and an NLS or a fusion protein of the invention comprising a Cas protein and an NLS, and (2) a nucleic acid molecule encoding a guide nucleic acid molecule comprising a targeting nucleotide sequence complimentary to a target RNA sequence in the nuclear RNA or a guide nucleic acid molecule comprising a targeting nucleotide sequence complimentary to a target RNA sequence in the nuclear RNA.

In one aspect, the present invention provides methods of treating a disease or disorder associated with increased gene expression. In one embodiment, the method comprises administering to the subject (1) a nucleic acid molecule encoding a fusion protein of the invention comprising a Cas protein and an NLS or a fusion protein of the invention comprising a Cas protein and an NLS, and (2) a nucleic acid molecule encoding a guide nucleic acid molecule comprising a targeting nucleotide sequence complimentary to a target RNA sequence in the RNA transcript of the gene or a guide nucleic acid molecule comprising a targeting nucleotide sequence complimentary to a target RNA sequence in the RNA transcript of the gene. In one embodiment, the Cas protein cleaves the RNA transcript thereby preventing translation and protein expression.

In one aspect, the present invention provides methods of treating a disease or disorder associated with RNA. For example, in one embodiment, the invention provides a method of treating an RNA virus infection. In one embodiment, the invention provides a method of treating a DNA virus infection. In one embodiment, the method comprises administering to the subject (1) a nucleic acid molecule encoding a fusion protein of the invention comprising a Cas protein and an NLS or a fusion protein of the invention comprising a Cas protein and an NLS, and (2) a nucleic acid molecule encoding a guide nucleic acid molecule comprising a targeting nucleotide sequence complimentary to a target RNA sequence in the viral RNA or a guide nucleic acid molecule comprising a targeting nucleotide sequence complimentary to a target RNA sequence in the viral RNA. In one embodiment, the Cas protein cleaves the RNA transcript thereby preventing translation and expression of viral protein.

Methods of Visualizing RNA

In one aspect, the present invention provides methods of visualizing nuclear RNA in a subject. In one embodiment, the method comprises (A) administering to the subject (1) a nucleic acid molecule encoding a fusion protein of the invention comprising a Cas protein and a fluorescent protein or a fusion protein of the invention comprising a Cas protein and a fluorescent protein, and (2) a nucleic acid molecule encoding a guide nucleic acid molecule comprising a targeting nucleotide sequence complimentary to a target RNA sequence in the nuclear RNA or a guide nucleic acid molecule comprising a targeting nucleotide sequence complimentary to a target RNA sequence in the nuclear RNA; and (B) visualizing the nuclear RNA. In one embodiment, visualizing the RNA occurs via imaging. In one embodiment, Cas protein binds the guide nucleic acid, the guide nucleic acid binds to the target RNA sequence and the fluorescent protein is detected.

In one embodiment, the method comprises administering to the subject a nucleic acid molecule comprising a nucleic acid sequence encoding a fusion protein comprising at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 699-701 and a guide nucleic acid comprising a targeting nucleotide sequence complimentary to a target region in a gene, wherein the gene encodes the RNA transcript. In one embodiment, the method comprises administering to the subject a nucleic acid molecule comprising a nucleic acid sequence least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 728-730 and a nucleic acid sequence encoding a guide nucleic acid comprising a targeting nucleotide sequence complimentary to a target region in a gene, wherein the gene encodes the RNA transcript.

In one embodiment, the method comprises administering to the subject a fusion protein comprising an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 699-701 and a guide nucleic acid comprising a targeting nucleotide sequence complimentary to a target region in a gene, wherein the gene encodes the RNA transcript.

In one embodiment, the subject is a cell. In one embodiment, the cell is a prokaryotic cell or eukaryotic cell. In one embodiment, the cell is a eukaryotic cell. In one embodiment, the cell is a plants, animals, or fungi cell. In one embodiment, the cell is a plant cell. In one embodiment, the cell is an animal cell. In one embodiment, the cell is a yeast cell.

In one embodiment, the subject is a mammal. For example, in one embodiment, the subject is a human, non-human primate, dog, cat, horse, cow, goat, sheep, rabbit, pig, rat, or mouse. In one embodiment, the subject is a non-mammalian subject. For example, in one embodiment, the subject is a zebrafish, fruit fly, or roundworm.

In one embodiment, the nuclear RNA is visualized in vitro. In one embodiment, the nuclear RNA is visualized in vivo.

In one embodiment, the nuclear RNA is nuclear RNA foci. In one embodiment, the crRNA comprises a sequence complementary to a CTG repeat expansion in the 3'UTR of the human dystrophia myotonica-protein kinase (DMPK) gene. In one embodiment, the crNA comprises a sequence of SEQ ID NO:23, SEQ ID NO:24, or SEQ ID NO:25.

In one embodiment, the invention provides a method of diagnosing a disease or disorder associated with abnormal nuclear RNA. In one embodiment, the method comprises administering (A) administering to the subject (1) a nucleic acid molecule encoding a fusion protein of the invention comprising a Cas protein and a fluorescent protein or a fusion protein of the invention comprising a Cas protein and a fluorescent protein, and (2) a nucleic acid molecule encoding a guide nucleic acid molecule comprising a targeting nucleotide sequence complimentary to a target RNA sequence in the nuclear RNA or a guide nucleic acid molecule comprising a targeting nucleotide sequence complimentary to a target RNA sequence in the abnormal nuclear RNA; (B) visualizing the abnormal nuclear RNA; and (C) diagnosing the disease or disorder when the abnormal nuclear RNA is present.

Methods of Treatment and Use

The present invention provides methods of treating, reducing the symptoms of, and/or reducing the risk of developing a disease or disorder in a subject. For example, in one embodiment, methods of the invention of treat, reduce the symptoms of, and/or reduce the risk of developing a disease or disorder in a mammal. In one embodiment, the methods of the invention of treat, reduce the symptoms of, and/or reduce the risk of developing a disease or disorder in a plant. In one embodiment, the methods of the invention of treat, reduce the symptoms of, and/or reduce the risk of developing a disease or disorder in a yeast organism.

In one embodiment, the subject is a cell. In one embodiment, the cell is a prokaryotic cell or eukaryotic cell. In one embodiment, the cell is a eukaryotic cell. In one embodiment, the cell is a plants, animals, or fungi cell. In one embodiment, the cell is a plant cell. In one embodiment, the cell is an animal cell. In one embodiment, the cell is a yeast cell.

In one embodiment, the subject is a mammal. For example, in one embodiment, the subject is a human, non-human primate, dog, cat, horse, cow, goat, sheep, rabbit, pig, rat, or mouse. In one embodiment, the subject is a non-mammalian subject. For example, in one embodiment, the subject is a zebrafish, fruit fly, or roundworm.

In one embodiment, the disease or disorder is caused by one or more mutations in a genomic locus. Thus, in one embodiment, the disease or disorder is may be treated, reduced, or the risk can be reduced via an element that prevents or reduces mRNA transcript, or prevents or reduces translation of the protein. Thus, in one embodiment, the method comprises manipulation of an RNA transcript.

In one embodiment, the disease or disorder is caused by abnormal RNA. Thus, in one embodiment, the disease or disorder is may be treated, reduced, or the risk can be reduced via an element that prevents or reduces RNA transcript. Thus, in one embodiment, the method comprises manipulation of an RNA transcript.

In one embodiment, the method comprises administering to the subject (1) a nucleic acid molecule encoding a fusion protein of the invention comprising a Cas protein a cleavage and/or polyadenylation protein, and (2) a guide nucleic acid molecule comprising a targeting nucleotide sequence complimentary to a target region in a gene, wherein the gene encodes the RNA transcript. In one embodiment, the cleavage and/or polyadenylation protein modulates the cleavage and/or polyadenylation of the RNA transcript.

In one embodiment, the method comprises administering to the subject a nucleic acid molecule comprising a nucleic acid sequence encoding a fusion protein comprising at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 696-698 and a guide nucleic acid comprising a targeting nucleotide sequence complimentary to a target region in a gene, wherein the gene encodes the RNA transcript. In one embodiment, the method comprises administering to the subject a nucleic acid molecule comprising a nucleic acid sequence least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 725-727 and a nucleic acid sequence encoding a guide nucleic acid comprising a targeting nucleotide sequence complimentary to a target region in a gene, wherein the gene encodes the RNA transcript.

In one embodiment, the method comprises administering to the subject a fusion protein comprising an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs: 696-698 and a guide nucleic acid comprising a targeting nucleotide sequence complimentary to a target region in a gene, wherein the gene encodes the RNA transcript.

In one embodiment, the method comprises administering to the subject (1) a nucleic acid molecule encoding a fusion protein of the invention comprising a Cas protein and an NLS or a fusion protein of the invention comprising a Cas protein and an NLS, and (2) a nucleic acid molecule encoding a guide nucleic acid molecule comprising a targeting nucleotide sequence complimentary to a target RNA sequence in the nuclear RNA or a guide nucleic acid molecule comprising a targeting nucleotide sequence complimentary to a target RNA sequence in the nuclear RNA.

In one embodiment, the method comprises administering to the subject (1) a nucleic acid molecule encoding a fusion protein of the invention comprising a Cas protein and an NLS or a fusion protein of the invention comprising a Cas protein and an NLS, and (2) a nucleic acid molecule encoding a guide nucleic acid molecule comprising a targeting nucleotide sequence complimentary to a target RNA sequence in the nuclear RNA or a guide nucleic acid molecule comprising a targeting nucleotide sequence complimentary to a target RNA sequence in the nuclear RNA. In one embodiment, the Cas protein cleaves the RNA transcript.

In one embodiment, the method comprises administering to the subject a nucleic acid molecule comprising a nucleic acid sequence encoding a fusion protein comprising at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:702 and a guide nucleic acid comprising a targeting nucleotide sequence complimentary to a target region in a gene, wherein the gene encodes the RNA transcript. In one embodiment, the method comprises administering to the subject a nucleic acid molecule comprising a nucleic acid sequence least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to SEQ ID NO:731 and a nucleic acid sequence encoding a guide nucleic acid comprising a targeting nucleotide sequence complimentary to a target region in a gene, wherein the gene encodes the RNA transcript.

In one embodiment, the method comprises administering to the subject a fusion protein comprising an amino acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, 90%, at least 91%, at least 92%, at least 93%, at least 94%, at least 95%, at least 96%, at least 97%, at least 98%, or at least 99% identical to one of SEQ ID NOs:702 and a guide nucleic acid comprising a targeting nucleotide sequence complimentary to a target region in a gene, wherein the gene encodes the RNA transcript.

In one embodiment, the disease or disorder is associated with RNA. For example, in one embodiment, the diseases or disorder is an RNA virus or DNA virus infection. In one embodiment, the RNA virus is a positive strand RNA virus, a negative strand RNA virus or a double-stranded RNA virus.

Exemplary RNA viruses include, but are not limited to, Primate T-lymphotropic virus 1, Primate T-lymphotropic virus 2, Primate T-lymphotropic virus 3, Human immunodeficiency virus 1, Human immunodeficiency virus 2, Simian foamy virus, Human picobirnavirus, Colorado tick fever virus, Changuinola virus, Great Island virus, Lebombo virus, Orungo virus, Rotavirus A, Rotavirus B, Rotavirus C, Banna virus, Borna disease virus, Lake Victoria Marburgvirus, Reston ebolavirus, Sudan ebolavirus, Tai forest ebolavirus, Zaire virus, Human parainfluenza virus 2, Human parainfluenza virus 4, Mumps virus, Newcastle disease virus, Human parainfluenza virus 1, Human parainfluenza virus 3, Hendra virus, Nipah virus, Measles virus, Human respiratory syncytial virus, Human metapneumovirus, Chandipura virus, Isfahan virus, Piry virus, Vesicular stomatitis Alagoas virus, Vesicular stomatitis Indiana virus, Vesicular stomatitis New Jersey virus, Australian bat lyssavirus, Duvenhage virus, European bat lyssavirus 1, European bat lyssavirus 2, Mokola virus, Rabies virus, Guanarito virus, Junin virus, Lassa virus, Lymphocytic choriomeningitis virus, Machupo virus, Pichinde virus, Sabia virus, Whitewater Arroyo virus, Bunyamwera virus, Bwamba virus, California encephalitis virus, Caraparu virus, Catu virus, Guama virus, Guaroa virus, Kairi virus, Marituba virus, Oriboca virus, Oropouche virus, Shuni virus, Tacaiuma virus, Wyeomyia virus, Andes virus, Bayou virus, Black creek canal virus, Dobrava-Belgrade virus, Hantaan virus, Laguna Negra virus, New York virus, Puumala virus, Seoul virus, Sin Nombre virus, Crimean-Congo haemorrhagic fever virus, Dugbe virus, Candiru virus, Punta Toro virus, Rift Valley fever virus, Sandfly fever Naples virus, Influenza A virus, Influenza B virus, Influenza C virus, Dhori virus, Thogoto virus, Hepatitis delta virus, Human coronavirus 229E, Human coronavirus NL63, Human coronavirus HKU1, Human coronavirus 0C43, SARS coronavirus, Human torovirus, Human enterovirus A, Human enterovirus B, Human enterovirus C, Human enterovirus D, Human rhinovirus A, Human rhinovirus B, Human rhinovirus C, Encephalomyocarditis virus, Theilovirus, Equine rhinitis A virus, Foot and mouth disease virus, Hepatitis A virus, Human parechovirus, Ljungan virus, Aichi virus, Human astrovirus, Human astrovirus 2, Human astrovirus 3, Human astrovirus 4, Human astrovirus 5, Human astrovirus 6, Human astrovirus 7, Human astrovirus 8, Norwalk virus, Sapporo virus, Aroa virus, Banzi virus, Dengue virus, Ilheus virus, Japanese encephalitis virus, Kokobera virus, Kyasanur forest disease virus, Louping ill virus, Murray Valley encephalitis virus, Ntaya virus, Omsk haemorrhagic fever virus, Powassan virus, Rio Bravo virus, St Louis encephalitis virus, Tick-borne encephalitis virus, Usutu virus, Wesselsbron virus, West Nile virus, Yellow fever virus, Zika virus, Hepatitis C virus, Hepatitis E virus, Barmah Forest virus, Chikungunya virus, Eastern equine encephalitis virus, Everglades virus, Getah virus, Mayaro virus, Mucambo virus, O'nyong-nyong virus, Pixuna virus, Ross River virus, Semliki Forest virus, Sindbis virus, Venezuelan equine encephalitis virus, Western equine encephalitis virus, Whataroa virus, Rubella virus.

In one embodiment, the DNA virus is a single-stranded DNA virus, or a double-stranded DNA virus. Exemplary DNA viruses include, but are not limited to, AAV9, AAV12, AAV18, AAV31, HBV, EBV, KSHV, HPV6, HPV11, HPV16, HPV18, HPV31, HPV45, Merkel cell polymavirus, and MCV.

In one embodiment, the disease or disorder is associated with abnormal polyadenylation or abnormal RNA. In one embodiment, the method treats the disease or disorder associated with abnormal polyadenylation or abnormal RNA, wherein the abnormal polyadenylation or abnormal RNA is targeted.

In one embodiment, the disease or disorder is an endocrine disease. For example, in one embodiment, endocrine diseases include but are not limited to, β-thalassemias, neonatal diabetes, IPEX syndrome, Mayer-Rokitanski-Küster-Hausersyndrome, Hypothalamic-pituitary-adrenal axis dysregulation, Adrenal dysfunction, Gonadal dysfunction, Ectopic Cushing syndrome, Pre-eclampsia, Diabetic nephropathy, Type I diabetes, Type II diabetes, and IGF-1 deficiency.

In one embodiment, the disease or disorder is a tumorigenic disease. For example, in one embodiment, tumorigenic diseases include but are not limited to, mantle cell lymphoma, hereditary & sporadic parathyroid tumors, Medullary thyroid carcinoma, poliverative conditions, colorectal cancer, gliblastoma, Chronic lymphocytic leukaemia, and Breast cancer In one embodiment, the disease or disorder is a neurological disease or disorder. For example, in one embodiment, neurological diseases include but are not limited to, Parkinsons diseases, Oculopharyngeal muscular dystrophy, Huntington's disease, Fabry disease, Fragile X syndrome, spinal muscular atrophy, Amyotrophic Lateral Sclerosis, Spinocerebellar ataxia Spinocerebellar ataxia 1, Spinocerebellar ataxia 2, Spinocerebellar ataxia 3, Spinocerebellar ataxia 6, Spinocerebellar ataxia 7, Spinocerebellar ataxia 8, Spinocerebellar ataxia 10, Spinocerebellar ataxia 17, Spinocerebellar ataxia 31, and Alzheimer's disease.

In one embodiment, the disease or disorder is a hematological disease or disorder. For example, in one embodiment, hematological diseases include but are not limited to, β-Thalassemia, and α-Thalassemia.

In one embodiment, the disease or disorder is an infection or immunological disease or disorder. For example, in one embodiment, infection or immunological diseases include but are not limited to, B-cell differentiation, T-cell activation, systemic lupus erythematosus, Wiskott-Aldrich syndrome, Osteoarthris, scleroderma, and IPEX syndrome.

In one embodiment, the disease or disorder is a musculoskeletal disease or disorder. For example, in one embodiment, infection or immunological diseases include Myotonic dystrophy type 1, Spinal and bulbar muscular atrophy, and Dentatorubral-pallidoluysian atrophy.

Exemplary diseases or disorders and corresponding targets include, but are not limited to those listed in Table 2. Additional diseases and disorders and corresponding genes are known in the art, for example in Rehfeld et al., *Alternations in Polyadenylation and its Implications for Endocrine Disease*, Front. Endocrinol. 4:53 (2013), Chang et al., *Alternative Polyadenylation in Human Diseases*, Endocrinol Metab. 32:413-421 (2017), and Curinha et al., *Implications of polyadenylation in health and disease*, Nucleus 5:508-519 (2014), which are herein incorporated by reference in their entireties.

TABLE 2

Diseases or disorders and target gene

| Condition | Target |
|---|---|
| Adrenal dysfunction | STAR |
| Alzheimer's disease | ABCA3, EIF2B3, MSTO2P, OGDHL, PARP6, SLC33A1, SUPV3L1, TAF3, WASH7P, JAK1, ABCA3, UBR1, ALDOC, C10ord10, GABARAPL2, KAT2A, POLR3A, SH3BGRL2, TIMM23, TMC6, UNC80, WTAP |
| Amyotrophic Lateral Sclerosis | ALS (GGGGCC repeat), CCDC92, CRYAB, MAP7D2, PRPH, RTN4, SEC22B, SNAP25, UCHL1, YWHAB, C14ord2, C6orf203, ALDOC, ARL6IP1, CSDE1, CMC2, GAP43, LDHB, MLLT11, NCL, PFN2, TMOD1, VAMP1 |
| B-cell differentiation | IGHM |
| B-cell differentiation | IGHM |
| Breast cancer | |
| Cancer, Colorectal | DMKN, PDXK, PPIE |
| Cancer, Various | TP53 |
| Chronic lymphocytic leukaemia | Intronic loci |
| Colorectal cancer | DMKN, PDXK, PPIE |
| Dentatorubral-pallidoluysian atrophy | DRPLA (CAG repeat) |
| Diabetic nephropathy | HGRG-14 |
| Diabetic nephropathy | HRG-14 |
| Ectopic Cushing syndrome | ACTH |
| Fabry disease | α-GalA |
| Fragile X Syndrome | FMR1, FXTAS (CGG repeat) |
| Friedreich's Ataxia | YSH1 |
| Glioblastoma | CCND1 |
| Glioblastoma | CCND1, MECP2 |
| Gonadal dysfunction | STAR |
| Huntington's disease | HTT, HD (CAG repeat) |
| Huntington's disease-like 2 | HDL2 (CTG repeat) |
| Hypothalamic-pituitary-adrenal axis dysregulation | SERT |
| IGF-1 deficiency | IGF-1 |
| IPEX syndrome | FOP3 |
| IPEX syndrome | FOXP3 |
| IPEX Syndrome | FOXP3 |
| Mayer-Rokitanski-Küster-Hausersyndrome | AMH |
| Myotonic Dystrophy Type I | DMPK, DM1 (CTG Repeat), DM2 (CCTG repeat) |
| Myotonic Dystrophy Type II | ZFN9 |
| neonatal diabetes | INS |
| Neonatal diabetes | INS |
| Oculopharyngeal muscular dystrophy | CCND1 |
| Oculopharyngeal muscular dystrophy | PABPN1 |
| Parkinson disease | SNCA |
| Parkinson's disease | SNCA |
| Pre-eclampsia | SFLT-1 |
| Proliferative conditions | RBX1 |
| Proliferative conditions | RBX1 |
| Spinal Muscular Atrophy | SMN |
| Spinocerebellar Ataxia 1 | ATXN1, SCA1 (CAG repeat) |
| Spinocerebellar Ataxia 10 | ATXN10, SCA10 (ATTCT repeat) |
| Spinocerebellar Ataxia 17 | TATA-box binding protein, SCA17 (CAG repeat) |
| Spinocerebellar Ataxia 2 | ATXN2, SCA2 (CAG repeat) |
| Spinocerebellar Ataxia 3 | ATXN3, SCA3 (CAG repeat) |
| Spinocerebellar Ataxia 31 | BEAN1, SCA31 (TGGA repeat) |
| Spinocerebellar Ataxia 6 | CACNA1A, SCA6 (CAG repeat) |
| Spinocerebellar Ataxia 7 | TPP1, SCA7 (CAG repeat) |
| Spinocerebellar Ataxia 8 | ATXN8OS, SCA8 (CTG/CAG repeat) |
| Spinal and bulbar muscular atrophy | SBMA (CAG repeat) |
| Steroidogenesis | STAR |
| Steroidogenesis | STAR |
| Systemic lupus erythematosus | GIMAP5 |
| Systemic lupus erythematosus | GIMAP5 |
| Systemic lupus erythematosus | IRF5 |
| T-cell activation | NF-ATC1 |
| T-cell activation | NF-ATC1 |
| Thrombophilia | F2 |
| Type I diabetes | GIMAP5 |
| Type I diabetes | GIMAP5 |

TABLE 2-continued

Diseases or disorders and target gene

| Condition | Target |
| --- | --- |
| Type II diabetes | TCF7L2 |
| Wiskott-Aldrich Syndrome | WAS |
| α-Thalassaemia | HBA1, HBA2 |
| β-Thalassaemia | HBB |

Amino Acid and Nucleic Acid Sequences

Table 3 provides a reference of sequence.

TABLE 3

| SEQ ID NO | Type | Description |
| --- | --- | --- |
| 1 | Amino Acid | PspCas13b |
| 2 | Amino Acid | PspCas13b Truncation |
| 3 | Amino Acid | AspCas13b |
| 4 | Amino Acid | AspCas13c |
| 5 | Amino Acid | BmaCas13a |
| 6 | Amino Acid | BzoCas13b |
| 7 | Amino Acid | CamCas13a |
| 8 | Amino Acid | CcaCas13b |
| 9 | Amino Acid | Cga2Cas13a |
| 10 | Amino Acid | CgaCas13a |
| 11 | Amino Acid | EbaCas13a |
| 12 | Amino Acid | EreCas13a |
| 13 | Amino Acid | EsCas13d |
| 14 | Amino Acid | FbrCas13b |
| 15 | Amino Acid | FnbCas13c |
| 16 | Amino Acid | FndCas13c |
| 17 | Amino Acid | FnfCas13c |
| 18 | Amino Acid | FnsCas13c |
| 19 | Amino Acid | FpeCas13c |
| 20 | Amino Acid | FulCas13c |
| 21 | Amino Acid | HheCas13a |
| 22 | Amino Acid | LbfCas13a |
| 23 | Amino Acid | LbmCas13a |
| 24 | Amino Acid | LbnCas13a |
| 25 | Amino Acid | LbuCas13a |
| 26 | Amino Acid | LseCas13a |
| 27 | Amino Acid | LshCas13a |
| 28 | Amino Acid | LspCas13a |
| 29 | Amino Acid | Lwa2cas13a |
| 30 | Amino Acid | LwaCas13a |
| 31 | Amino Acid | LweCas13a |
| 32 | Amino Acid | PauCas13b |
| 33 | Amino Acid | PbuCas13b |
| 34 | Amino Acid | PgiCas13b |
| 35 | Amino Acid | PguCas13b |
| 36 | Amino Acid | Pin2Cas13b |
| 37 | Amino Acid | Pin3Cas13b |
| 38 | Amino Acid | PinCas13b |
| 39 | Amino Acid | PprCas13a |
| 40 | Amino Acid | PsaCas13b |
| 41 | Amino Acid | PsmCas13b |
| 42 | Amino Acid | RanCas13b |
| 43 | Amino Acid | RcdCas13a |
| 44 | Amino Acid | RcrCas13a |
| 45 | Amino Acid | RcsCas13a |
| 46 | Amino Acid | UrCas13d |
| 47 | Amino Acid | dPspCas13b |
| 48 | Amino Acid | dPspCas13b truncation |
| 49 | Amino Acid | CPSF30 |
| 50 | Amino Acid | WDR33 |
| 51 | Amino Acid | NUDT21 |
| 52 | Amino Acid | Worm NudT21 |
| 53 | Amino Acid | Fly NudT21 |
| 54 | Amino Acid | Zebrafish NUDT21 |
| 55 | Amino Acid | Human NUDT21 Truncation Mutant |
| 56 | Amino Acid | NUDT21 R63S |
| 57 | Amino Acid | NUDT21 F103A |
| 58 | Amino Acid | NudT21 Tandem Dimer |
| 59 | Amino Acid | eGFP |
| 60 | Amino Acid | mCherry |
| 61 | Amino Acid | sfCherry(1-10) |
| 62 | Amino Acid | sfCherry(1-10)-L-(11) |
| 63 | Amino Acid | 7xS11 |
| 64 | Amino Acid | sfGFP |
| 65 | Amino Acid | sfGFP(1-10) |
| 66 | Amino Acid | sfGFP(1-10)-L-(11) |
| 67 | Amino Acid | Linker sequence 1 |
| 68 | Amino Acid | Linker sequence 2 |
| 69 | Amino Acid | Linker sequence 3 |
| 70 | Amino Acid | Linker sequence 4 |
| 71 | Amino Acid | Linker sequence 5 |
| 72 | Amino Acid | Linker sequence 6 |
| 73 | Amino Acid | Linker sequence 7 |
| 74 | Amino Acid | 3xFlag |
| 75 | Amino Acid | Ty1 NLS |
| 76 | Amino Acid | Ty2 NLS |
| 77 | Amino Acid | MAK11 |
| 78 | Amino Acid | 1xSV40 |
| 79 | Amino Acid | 3xSV40 |
| 80 | Amino Acid | NPM |
| 81 | Amino Acid | STH1 |
| 82 | Amino Acid | INO4 |
| 83 | Amino Acid | Ty1-like NLS O28090-0 |
| 84 | Amino Acid | Ty1-like NLS O50087-0 |
| 85 | Amino Acid | Ty1-like NLS O58353-0 |
| 86 | Amino Acid | Ty1-like NLS Q57602-0 |
| 87 | Amino Acid | Ty1-like NLS Q6L1X9-0 |
| 88 | Amino Acid | Ty1-like NLS A0K3M1-0 |
| 89 | Amino Acid | Ty1-like NLS A0LYZ1-0 |
| 90 | Amino Acid | Ty1-like NLS A1B022-0 |
| 91 | Amino Acid | Ty1-like NLS A1V8A7-0 |
| 92 | Amino Acid | Ty1-like NLS A1VIP6-0 |
| 93 | Amino Acid | Ty1-like NLS A2RDW6-0 |
| 94 | Amino Acid | Ty1-like NLS A2S7H2-0 |
| 95 | Amino Acid | Ty1-like NLS A3MRV0-0 |
| 96 | Amino Acid | Ty1-like NLS A3NEI3-0 |
| 97 | Amino Acid | Ty1-like NLS A3P0B7-0 |
| 98 | Amino Acid | Ty1-like NLS A4JAN6-0 |
| 99 | Amino Acid | Ty1-like NLS A4SUV7-0 |
| 100 | Amino Acid | Ty1-like NLS A5FP03-0 |
| 101 | Amino Acid | Ty1-like NLS A5ILZ2-0 |
| 102 | Amino Acid | Ty1-like NLS A6GY20-0 |
| 103 | Amino Acid | Ty1-like NLS A6LLI5-0 |
| 104 | Amino Acid | Ty1-like NLS A6LQX4-0 |
| 105 | Amino Acid | Ty1-like NLS A8F6X2-0 |
| 106 | Amino Acid | Ty1-like NLS A8G6B7-0 |
| 107 | Amino Acid | Ty1-like NLS A9ADI9-0 |
| 108 | Amino Acid | Ty1-like NLS A9IJ08-0 |
| 109 | Amino Acid | Ty1-like NLS A9IXA1-0 |
| 110 | Amino Acid | Ty1-like NLS A9NEN2-0 |
| 111 | Amino Acid | Ty1-like NLS B0S140-0 |
| 112 | Amino Acid | Ty1-like NLS B1JU18-0 |
| 113 | Amino Acid | Ty1-like NLS B1LBA1-0 |
| 114 | Amino Acid | Ty1-like NLS B1W354-0 |
| 115 | Amino Acid | Ty1-like NLS B1XSP7-0 |
| 116 | Amino Acid | Ty1-like NLS B1YRC6-0 |
| 117 | Amino Acid | Ty1-like NLS B2JIH0-0 |
| 118 | Amino Acid | Ty1-like NLS B2T755-0 |
| 119 | Amino Acid | Ty1-like NLS B2UEM3-0 |
| 120 | Amino Acid | Ty1-like NLS B3PLU0-0 |
| 121 | Amino Acid | Ty1-like NLS B3R7T2-0 |
| 122 | Amino Acid | Ty1-like NLS B4E5B6-0 |
| 123 | Amino Acid | Ty1-like NLS B4S3C9-0 |
| 124 | Amino Acid | Ty1-like NLS B7IHT4-0 |
| 125 | Amino Acid | Ty1-like NLS B8E0X6-0 |

TABLE 3-continued

| SEQ ID NO | Type | Description |
|---|---|---|
| 126 | Amino Acid | Ty1-like NLS B9K7W0-0 |
| 127 | Amino Acid | Ty1-like NLS C1A494-0 |
| 128 | Amino Acid | Ty1-like NLS C5CE41-0 |
| 129 | Amino Acid | Ty1-like NLS O88058-0 |
| 130 | Amino Acid | Ty1-like NLS P0DG92-0 |
| 131 | Amino Acid | Ty1-like NLS P0DG93-0 |
| 132 | Amino Acid | Ty1-like NLS P60554-0 |
| 133 | Amino Acid | Ty1-like NLS P67354-0 |
| 134 | Amino Acid | Ty1-like NLS P75311-0 |
| 135 | Amino Acid | Ty1-like NLS P75471-0 |
| 136 | Amino Acid | Ty1-like NLS P94372-0 |
| 137 | Amino Acid | Ty1-like NLS Q056Y0-0 |
| 138 | Amino Acid | Ty1-like NLS Q057D7-0 |
| 139 | Amino Acid | Ty1-like NLS Q0AYB7-0 |
| 140 | Amino Acid | Ty1-like NLS Q0BJ50-0 |
| 141 | Amino Acid | Ty1-like NLS Q0K610-0 |
| 142 | Amino Acid | Ty1-like NLS Q0STA4-0 |
| 143 | Amino Acid | Ty1-like NLS Q0STL9-0 |
| 144 | Amino Acid | Ty1-like NLS Q0TQV7-0 |
| 145 | Amino Acid | Ty1-like NLS Q0TR88-0 |
| 146 | Amino Acid | Ty1-like NLS Q12GX5-0 |
| 147 | Amino Acid | Ty1-like NLS Q13TG6-0 |
| 148 | Amino Acid | Ty1-like NLS Q1AWG1-0 |
| 149 | Amino Acid | Ty1-like NLS Q1BRU4-0 |
| 150 | Amino Acid | Ty1-like NLS Q1J5X5-0 |
| 151 | Amino Acid | Ty1-like NLS Q1JAY8-0 |
| 152 | Amino Acid | Ty1-like NLS Q1JG57-0 |
| 153 | Amino Acid | Ty1-like NLS Q1JL34-0 |
| 154 | Amino Acid | Ty1-like NLS Q1LI28-0 |
| 155 | Amino Acid | Ty1-like NLS Q2L2H3-0 |
| 156 | Amino Acid | Ty1-like NLS Q2NIH1-0 |
| 157 | Amino Acid | Ty1-like NLS Q2SU23-0 |
| 158 | Amino Acid | Ty1-like NLS Q39KH1-0 |
| 159 | Amino Acid | Ty1-like NLS Q3JMQ8-0 |
| 160 | Amino Acid | Ty1-like NLS Q3YRL8-0 |
| 161 | Amino Acid | Ty1-like NLS Q46WD9-0 |
| 162 | Amino Acid | Ty1-like NLS Q48SQ4-0 |
| 163 | Amino Acid | Ty1-like NLS Q49418-0 |
| 164 | Amino Acid | Ty1-like NLS Q56307-0 |
| 165 | Amino Acid | Ty1-like NLS Q5LEQ4-0 |
| 166 | Amino Acid | Ty1-like NLS Q5WEJ7-0 |
| 167 | Amino Acid | Ty1-like NLS Q5XBA0-0 |
| 168 | Amino Acid | Ty1-like NLS Q62GK1-0 |
| 169 | Amino Acid | Ty1-like NLS Q63Q07-0 |
| 170 | Amino Acid | Ty1-like NLS Q64VP0-0 |
| 171 | Amino Acid | Ty1-like NLS Q6G3V1-0 |
| 172 | Amino Acid | Ty1-like NLS Q6G5M0-0 |
| 173 | Amino Acid | Ty1-like NLS Q6LLQ8-0 |
| 174 | Amino Acid | Ty1-like NLS Q6MDC1-0 |
| 175 | Amino Acid | Ty1-like NLS Q6MDH4-0 |
| 176 | Amino Acid | Ty1-like NLS Q6ME08-0 |
| 177 | Amino Acid | Ty1-like NLS Q73PH4-0 |
| 178 | Amino Acid | Ty1-like NLS Q7MAD1-0 |
| 179 | Amino Acid | Ty1-like NLS Q7UP72-0 |
| 180 | Amino Acid | Ty1-like NLS Q7VTD6-0 |
| 181 | Amino Acid | Ty1-like NLS Q7W2F9-0 |
| 182 | Amino Acid | Ty1-like NLS Q7WRC8-0 |
| 183 | Amino Acid | Ty1-like NLS Q828D0-0 |
| 184 | Amino Acid | Ty1-like NLS Q895M9-0 |
| 185 | Amino Acid | Ty1-like NLS Q8AAP0-0 |
| 186 | Amino Acid | Ty1-like NLS Q8D1X2-0 |
| 187 | Amino Acid | Ty1-like NLS Q8K908-0 |
| 188 | Amino Acid | Ty1-like NLS Q8P0C9-0 |
| 189 | Amino Acid | Ty1-like NLS Q8XKR1-0 |
| 190 | Amino Acid | Ty1-like NLS Q8XL46-0 |
| 191 | Amino Acid | Ty1-like NLS Q8XV09-0 |
| 192 | Amino Acid | Ty1-like NLS Q93Q47-0 |
| 193 | Amino Acid | Ty1-like NLS Q9L0Q6-0 |
| 194 | Amino Acid | Ty1-like NLS Q9L0Q6-1 |
| 195 | Amino Acid | Ty1-like NLS Q9L0Q6-2 |
| 196 | Amino Acid | Ty1-like NLS Q9L0Q6-3 |
| 197 | Amino Acid | Ty1-like NLS Q9L0Q6-4 |
| 198 | Amino Acid | Ty1-like NLS Q9L0Q6-5 |
| 199 | Amino Acid | Ty1-like NLS Q9L0Q6-6 |
| 200 | Amino Acid | Ty1-like NLS Q9X1S8-0 |
| 201 | Amino Acid | Ty1-like NLS A1CNV8-0 |
| 202 | Amino Acid | Ty1-like NLS A1D1R8-0 |
| 203 | Amino Acid | Ty1-like NLS A1D731-0 |
| 204 | Amino Acid | Ty1-like NLS A2QAX7-0 |
| 205 | Amino Acid | Ty1-like NLS A3LQ55-0 |
| 206 | Amino Acid | Ty1-like NLS A5DGY0-0 |
| 207 | Amino Acid | Ty1-like NLS A5DKW3-0 |
| 208 | Amino Acid | Ty1-like NLS A5DLG8-0 |
| 209 | Amino Acid | Ty1-like NLS A5DY34-0 |
| 210 | Amino Acid | Ty1-like NLS A6RBB0-0 |
| 211 | Amino Acid | Ty1-like NLS A6RMZ2-0 |
| 212 | Amino Acid | Ty1-like NLS A6ZL85-0 |
| 213 | Amino Acid | Ty1-like NLS A6ZZJ1-0 |
| 214 | Amino Acid | Ty1-like NLS A7E4K0-0 |
| 215 | Amino Acid | Ty1-like NLS G0S8I1-0 |
| 216 | Amino Acid | Ty1-like NLS O13527-0 |
| 217 | Amino Acid | Ty1-like NLS O13535-0 |
| 218 | Amino Acid | Ty1-like NLS O13658-0 |
| 219 | Amino Acid | Ty1-like NLS O14064-0 |
| 220 | Amino Acid | Ty1-like NLS O14076-0 |
| 221 | Amino Acid | Ty1-like NLS O42668-0 |
| 222 | Amino Acid | Ty1-like NLS O43068-0 |
| 223 | Amino Acid | Ty1-like NLS O74777-0 |
| 224 | Amino Acid | Ty1-like NLS O74862-0 |
| 225 | Amino Acid | Ty1-like NLS O94383-0 |
| 226 | Amino Acid | Ty1-like NLS O94487-0 |
| 227 | Amino Acid | Ty1-like NLS O94585-0 |
| 228 | Amino Acid | Ty1-like NLS O94652-0 |
| 229 | Amino Acid | Ty1-like NLS P0C2I2-0 |
| 230 | Amino Acid | Ty1-like NLS P0C2I3-0 |
| 231 | Amino Acid | Ty1-like NLS P0C2I5-0 |
| 232 | Amino Acid | Ty1-like NLS P0C2I6-0 |
| 233 | Amino Acid | Ty1-like NLS P0C2I7-0 |
| 234 | Amino Acid | Ty1-like NLS P0C2I9-0 |
| 235 | Amino Acid | Ty1-like NLS P0C2J0-0 |
| 236 | Amino Acid | Ty1-like NLS P0C2J1-0 |
| 237 | Amino Acid | Ty1-like NLS P0C2J3-0 |
| 238 | Amino Acid | Ty1-like NLS P0C2J5-0 |
| 239 | Amino Acid | Ty1-like NLS P0CM98-0 |
| 240 | Amino Acid | Ty1-like NLS P0CM99-0 |
| 241 | Amino Acid | Ty1-like NLS P0CX63-0 |
| 242 | Amino Acid | Ty1-like NLS P0CX64-0 |
| 243 | Amino Acid | Ty1-like NLS P13902-0 |
| 244 | Amino Acid | Ty1-like NLS P14746-0 |
| 245 | Amino Acid | Ty1-like NLS P20484-0 |
| 246 | Amino Acid | Ty1-like NLS P22936-0 |
| 247 | Amino Acid | Ty1-like NLS P25384-0 |
| 248 | Amino Acid | Ty1-like NLS P32597-0 |
| 249 | Amino Acid | Ty1-like NLS P36006-0 |
| 250 | Amino Acid | Ty1-like NLS P36080-0 |
| 251 | Amino Acid | Ty1-like NLS P38112-0 |
| 252 | Amino Acid | Ty1-like NLS P47098-0 |
| 253 | Amino Acid | Ty1-like NLS P47100-0 |
| 254 | Amino Acid | Ty1-like NLS P51599-0 |
| 255 | Amino Acid | Ty1-like NLS P53119-0 |
| 256 | Amino Acid | Ty1-like NLS P53123-0 |
| 257 | Amino Acid | Ty1-like NLS P53125-0 |
| 258 | Amino Acid | Ty1-like NLS Q01301-0 |
| 259 | Amino Acid | Ty1-like NLS Q03434-0 |
| 260 | Amino Acid | Ty1-like NLS Q03494-0 |
| 261 | Amino Acid | Ty1-like NLS Q03612-0 |
| 262 | Amino Acid | Ty1-like NLS Q03619-0 |
| 263 | Amino Acid | Ty1-like NLS Q03707-0 |
| 264 | Amino Acid | Ty1-like NLS Q03855-0 |
| 265 | Amino Acid | Ty1-like NLS Q04214-0 |
| 266 | Amino Acid | Ty1-like NLS Q04500-0 |
| 267 | Amino Acid | Ty1-like NLS Q04670-0 |
| 268 | Amino Acid | Ty1-like NLS Q04711-0 |
| 269 | Amino Acid | Ty1-like NLS Q06132-0 |
| 270 | Amino Acid | Ty1-like NLS Q07163-0 |
| 271 | Amino Acid | Ty1-like NLS Q07509-0 |
| 272 | Amino Acid | Ty1-like NLS Q07791-0 |
| 273 | Amino Acid | Ty1-like NLS Q07793-0 |
| 274 | Amino Acid | Ty1-like NLS Q09094-0 |
| 275 | Amino Acid | Ty1-like NLS Q09180-0 |
| 276 | Amino Acid | Ty1-like NLS Q09180-1 |
| 277 | Amino Acid | Ty1-like NLS Q09180-2 |
| 278 | Amino Acid | Ty1-like NLS Q09863-0 |
| 279 | Amino Acid | Ty1-like NLS Q0U8V9-0 |
| 280 | Amino Acid | Ty1-like NLS Q12088-0 |
| 281 | Amino Acid | Ty1-like NLS Q12112-0 |

TABLE 3-continued

| SEQ ID NO | Type | Description |
|---|---|---|
| 282 | Amino Acid | Ty1-like NLS Q12113-0 |
| 283 | Amino Acid | Ty1-like NLS Q12141-0 |
| 284 | Amino Acid | Ty1-like NLS Q12193-0 |
| 285 | Amino Acid | Ty1-like NLS Q12269-0 |
| 286 | Amino Acid | Ty1-like NLS Q12273-0 |
| 287 | Amino Acid | Ty1-like NLS Q12316-0 |
| 288 | Amino Acid | Ty1-like NLS Q12337-0 |
| 289 | Amino Acid | Ty1-like NLS Q12339-0 |
| 290 | Amino Acid | Ty1-like NLS Q12414-0 |
| 291 | Amino Acid | Ty1-like NLS Q12472-0 |
| 292 | Amino Acid | Ty1-like NLS Q12490-0 |
| 293 | Amino Acid | Ty1-like NLS Q12491-0 |
| 294 | Amino Acid | Ty1-like NLS Q12501-0 |
| 295 | Amino Acid | Ty1-like NLS Q1DNW5-0 |
| 296 | Amino Acid | Ty1-like NLS Q1EA54-0 |
| 297 | Amino Acid | Ty1-like NLS Q2HFA6-0 |
| 298 | Amino Acid | Ty1-like NLS Q2HFA6-1 |
| 299 | Amino Acid | Ty1-like NLS Q2UQI6-0 |
| 300 | Amino Acid | Ty1-like NLS Q4HZ42-0 |
| 301 | Amino Acid | Ty1-like NLS Q4P6I3-0 |
| 302 | Amino Acid | Ty1-like NLS Q4WHF8-0 |
| 303 | Amino Acid | Ty1-like NLS Q4WRV2-0 |
| 304 | Amino Acid | Ty1-like NLS Q4WXQ7-0 |
| 305 | Amino Acid | Ty1-like NLS Q5A2K0-0 |
| 306 | Amino Acid | Ty1-like NLS Q5A3I0-0 |
| 307 | Amino Acid | Ty1-like NLS Q5ACW8-0 |
| 308 | Amino Acid | Ty1-like NLS Q5B6K3-0 |
| 309 | Amino Acid | Ty1-like NLS Q6BXL7-0 |
| 310 | Amino Acid | Ty1-like NLS Q6C1L3-0 |
| 311 | Amino Acid | Ty1-like NLS Q6C233-0 |
| 312 | Amino Acid | Ty1-like NLS Q6C2J1-0 |
| 313 | Amino Acid | Ty1-like NLS Q6C7C0-0 |
| 314 | Amino Acid | Ty1-like NLS Q6CJY0-0 |
| 315 | Amino Acid | Ty1-like NLS Q6CJY0-1 |
| 316 | Amino Acid | Ty1-like NLS Q6FML5-0 |
| 317 | Amino Acid | Ty1-like NLS Q75F02-0 |
| 318 | Amino Acid | Ty1-like NLS Q7S2A9-0 |
| 319 | Amino Acid | Ty1-like NLS Q7S9J4-0 |
| 320 | Amino Acid | Ty1-like NLS Q7SFJ3-0 |
| 321 | Amino Acid | Ty1-like NLS Q875K1-0 |
| 322 | Amino Acid | Ty1-like NLS Q8SUT1-0 |
| 323 | Amino Acid | Ty1-like NLS Q8SVI7-0 |
| 324 | Amino Acid | Ty1-like NLS Q8SVI7-1 |
| 325 | Amino Acid | Ty1-like NLS Q92393-0 |
| 326 | Amino Acid | Ty1-like NLS Q99109-0 |
| 327 | Amino Acid | Ty1-like NLS Q99231-0 |
| 328 | Amino Acid | Ty1-like NLS Q99337-0 |
| 329 | Amino Acid | Ty1-like NLS Q9USK2-0 |
| 330 | Amino Acid | Ty1-like NLS Q9UTQ5-0 |
| 331 | Amino Acid | Ty1-like NLS A7MD48-0 |
| 332 | Amino Acid | Ty1-like NLS O15446-0 |
| 333 | Amino Acid | Ty1-like NLS O15446-1 |
| 334 | Amino Acid | Ty1-like NLS O15446-2 |
| 335 | Amino Acid | Ty1-like NLS O43148-0 |
| 336 | Amino Acid | Ty1-like NLS O60271-0 |
| 337 | Amino Acid | Ty1-like NLS O75128-0 |
| 338 | Amino Acid | Ty1-like NLS O75400-0 |
| 339 | Amino Acid | Ty1-like NLS O75691-0 |
| 340 | Amino Acid | Ty1-like NLS O75937-0 |
| 341 | Amino Acid | Ty1-like NLS O76021-0 |
| 342 | Amino Acid | Ty1-like NLS O94964-0 |
| 343 | Amino Acid | Ty1-like NLS P23497-0 |
| 344 | Amino Acid | Ty1-like NLS P30414-0 |
| 345 | Amino Acid | Ty1-like NLS P42081-0 |
| 346 | Amino Acid | Ty1-like NLS P46100-0 |
| 347 | Amino Acid | Ty1-like NLS P51608-0 |
| 348 | Amino Acid | Ty1-like NLS P59797-0 |
| 349 | Amino Acid | Ty1-like NLS P82979-0 |
| 350 | Amino Acid | Ty1-like NLS Q12830-0 |
| 351 | Amino Acid | Ty1-like NLS Q13409-0 |
| 352 | Amino Acid | Ty1-like NLS Q13427-0 |
| 353 | Amino Acid | Ty1-like NLS Q15361-0 |
| 354 | Amino Acid | Ty1-like NLS Q15361-1 |
| 355 | Amino Acid | Ty1-like NLS Q53SF7-0 |
| 356 | Amino Acid | Ty1-like NLS Q5M9Q1-0 |
| 357 | Amino Acid | Ty1-like NLS Q5T3I0-0 |
| 358 | Amino Acid | Ty1-like NLS Q5T3I0-1 |
| 359 | Amino Acid | Ty1-like NLS Q68D10-0 |
| 360 | Amino Acid | Ty1-like NLS Q6IPR3-0 |
| 361 | Amino Acid | Ty1-like NLS Q6PD62-0 |
| 362 | Amino Acid | Ty1-like NLS Q6PD62-1 |
| 363 | Amino Acid | Ty1-like NLS Q6PD62-2 |
| 364 | Amino Acid | Ty1-like NLS Q6S8J7-0 |
| 365 | Amino Acid | Ty1-like NLS Q6ZU65-0 |
| 366 | Amino Acid | Ty1-like NLS Q7Z7B0-0 |
| 367 | Amino Acid | Ty1-like NLS Q8N9E0-0 |
| 368 | Amino Acid | Ty1-like NLS Q8NCU4-0 |
| 369 | Amino Acid | Ty1-like NLS Q8NFU7-0 |
| 370 | Amino Acid | Ty1-like NLS Q96DY2-0 |
| 371 | Amino Acid | Ty1-like NLS Q96GD3-0 |
| 372 | Amino Acid | Ty1-like NLS Q96P65-0 |
| 373 | Amino Acid | Ty1-like NLS Q96QC0-0 |
| 374 | Amino Acid | Ty1-like NLS Q9BQG0-0 |
| 375 | Amino Acid | Ty1-like NLS Q9BQG0-1 |
| 376 | Amino Acid | Ty1-like NLS Q9BRU9-0 |
| 377 | Amino Acid | Ty1-like NLS Q9H0S4-0 |
| 378 | Amino Acid | Ty1-like NLS Q9H6F5-0 |
| 379 | Amino Acid | Ty1-like NLS Q9HCK1-0 |
| 380 | Amino Acid | Ty1-like NLS Q9HCK8-0 |
| 381 | Amino Acid | Ty1-like NLS Q9NPI1-0 |
| 382 | Amino Acid | Ty1-like NLS Q9NSV4-0 |
| 383 | Amino Acid | Ty1-like NLS Q9NUL3-0 |
| 384 | Amino Acid | Ty1-like NLS Q9NWT1-0 |
| 385 | Amino Acid | Ty1-like NLS Q9NX58-0 |
| 386 | Amino Acid | Ty1-like NLS Q9UGU5-0 |
| 387 | Amino Acid | Ty1-like NLS Q9UNS1-0 |
| 388 | Amino Acid | Ty1-like NLS Q9Y2X3-0 |
| 389 | Amino Acid | Ty1-like NLS Q9Y6X0-0 |
| 390 | Amino Acid | Ty1-like NLS A0A1I8M2I8-0 |
| 391 | Amino Acid | Ty1-like NLS A1XDC0-0 |
| 392 | Amino Acid | Ty1-like NLS A7S6A5-0 |
| 393 | Amino Acid | Ty1-like NLS A8XI07-0 |
| 394 | Amino Acid | Ty1-like NLS A8XI07-1 |
| 395 | Amino Acid | Ty1-like NLS C0HKU9-0 |
| 396 | Amino Acid | Ty1-like NLS C6KTD2-0 |
| 397 | Amino Acid | Ty1-like NLS O16140-0 |
| 398 | Amino Acid | Ty1-like NLS O17828-0 |
| 399 | Amino Acid | Ty1-like NLS O17966-0 |
| 400 | Amino Acid | Ty1-like NLS O44410-0 |
| 401 | Amino Acid | Ty1-like NLS O44410-1 |
| 402 | Amino Acid | Ty1-like NLS O45244-0 |
| 403 | Amino Acid | Ty1-like NLS P0DP78-0 |
| 404 | Amino Acid | Ty1-like NLS P0DP78-1 |
| 405 | Amino Acid | Ty1-like NLS P0DP79-0 |
| 406 | Amino Acid | Ty1-like NLS P0DP79-1 |
| 407 | Amino Acid | Ty1-like NLS P0DP80-0 |
| 408 | Amino Acid | Ty1-like NLS P0DP80-1 |
| 409 | Amino Acid | Ty1-like NLS P0DP81-0 |
| 410 | Amino Acid | Ty1-like NLS P0DP81-1 |
| 411 | Amino Acid | Ty1-like NLS P14196-0 |
| 412 | Amino Acid | Ty1-like NLS P22058-0 |
| 413 | Amino Acid | Ty1-like NLS P26023-0 |
| 414 | Amino Acid | Ty1-like NLS P26991-0 |
| 415 | Amino Acid | Ty1-like NLS P35978-0 |
| 416 | Amino Acid | Ty1-like NLS P46758-0 |
| 417 | Amino Acid | Ty1-like NLS P46758-1 |
| 418 | Amino Acid | Ty1-like NLS P46867-0 |
| 419 | Amino Acid | Ty1-like NLS P54644-0 |
| 420 | Amino Acid | Ty1-like NLS P54812-0 |
| 421 | Amino Acid | Ty1-like NLS P83212-0 |
| 422 | Amino Acid | Ty1-like NLS Q04621-0 |
| 423 | Amino Acid | Ty1-like NLS Q08696-0 |
| 424 | Amino Acid | Ty1-like NLS Q08696-1 |
| 425 | Amino Acid | Ty1-like NLS Q08696-2 |
| 426 | Amino Acid | Ty1-like NLS Q08696-3 |
| 427 | Amino Acid | Ty1-like NLS Q08696-4 |
| 428 | Amino Acid | Ty1-like NLS Q08696-5 |
| 429 | Amino Acid | Ty1-like NLS Q08696-6 |
| 430 | Amino Acid | Ty1-like NLS Q09223-0 |
| 431 | Amino Acid | Ty1-like NLS Q09595-0 |
| 432 | Amino Acid | Ty1-like NLS Q1ELU8-0 |
| 433 | Amino Acid | Ty1-like NLS Q23120-0 |
| 434 | Amino Acid | Ty1-like NLS Q23272-0 |
| 435 | Amino Acid | Ty1-like NLS Q24537-0 |
| 436 | Amino Acid | Ty1-like NLS Q27450-0 |
| 437 | Amino Acid | Ty1-like NLS Q29DY1-0 |

TABLE 3-continued

| SEQ ID NO | Type | Description |
|---|---|---|
| 438 | Amino Acid | Ty1-like NLS Q4N4T9-0 |
| 439 | Amino Acid | Ty1-like NLS Q54QQ2-0 |
| 440 | Amino Acid | Ty1-like NLS Q54QQ2-1 |
| 441 | Amino Acid | Ty1-like NLS Q54S20-0 |
| 442 | Amino Acid | Ty1-like NLS Q54US6-0 |
| 443 | Amino Acid | Ty1-like NLS Q54VU4-0 |
| 444 | Amino Acid | Ty1-like NLS Q54XP6-0 |
| 445 | Amino Acid | Ty1-like NLS Q55IH0-0 |
| 446 | Amino Acid | Ty1-like NLS Q557G1-0 |
| 447 | Amino Acid | Ty1-like NLS Q55CE0-0 |
| 448 | Amino Acid | Ty1-like NLS Q61R02-0 |
| 449 | Amino Acid | Ty1-like NLS Q75JP5-0 |
| 450 | Amino Acid | Ty1-like NLS Q8I5P7-0 |
| 451 | Amino Acid | Ty1-like NLS Q8I5P7-1 |
| 452 | Amino Acid | Ty1-like NLS Q8IBP1-0 |
| 453 | Amino Acid | Ty1-like NLS Q8ILR9-0 |
| 454 | Amino Acid | Ty1-like NLS Q93591-0 |
| 455 | Amino Acid | Ty1-like NLS Q95Y36-0 |
| 456 | Amino Acid | Ty1-like NLS Q9NBL2-0 |
| 457 | Amino Acid | Ty1-like NLS Q9NDE8-0 |
| 458 | Amino Acid | Ty1-like NLS Q9NDE8-1 |
| 459 | Amino Acid | Ty1-like NLS Q9NDE8-2 |
| 460 | Amino Acid | Ty1-like NLS Q9V5P6-0 |
| 461 | Amino Acid | Ty1-like NLS Q9VDS6-0 |
| 462 | Amino Acid | Ty1-like NLS Q9VGW1-0 |
| 463 | Amino Acid | Ty1-like NLS Q9VH89-0 |
| 464 | Amino Acid | Ty1-like NLS Q9VKM6-0 |
| 465 | Amino Acid | Ty1-like NLS Q9VNH1-0 |
| 466 | Amino Acid | Ty1-like NLS Q9W261-0 |
| 467 | Amino Acid | Ty1-like NLS E1B7L7-0 |
| 468 | Amino Acid | Ty1-like NLS Q08DU1-0 |
| 469 | Amino Acid | Ty1-like NLS Q0III3-0 |
| 470 | Amino Acid | Ty1-like NLS Q17QH9-0 |
| 471 | Amino Acid | Ty1-like NLS Q29S22-0 |
| 472 | Amino Acid | Ty1-like NLS Q2KIQ2-0 |
| 473 | Amino Acid | Ty1-like NLS Q2KJE1-0 |
| 474 | Amino Acid | Ty1-like NLS Q2KJE1-1 |
| 475 | Amino Acid | Ty1-like NLS Q2TBX7-0 |
| 476 | Amino Acid | Ty1-like NLS Q4R7K1-0 |
| 477 | Amino Acid | Ty1-like NLS Q4R8Y5-0 |
| 478 | Amino Acid | Ty1-like NLS Q58DE2-0 |
| 479 | Amino Acid | Ty1-like NLS Q58DU0-0 |
| 480 | Amino Acid | Ty1-like NLS Q5E9U4-0 |
| 481 | Amino Acid | Ty1-like NLS Q5NVM2-0 |
| 482 | Amino Acid | Ty1-like NLS Q5R4V4-0 |
| 483 | Amino Acid | Ty1-like NLS Q5R8B0-0 |
| 484 | Amino Acid | Ty1-like NLS Q5RB69-0 |
| 485 | Amino Acid | Ty1-like NLS Q5RCE6-0 |
| 486 | Amino Acid | Ty1-like NLS Q5TM61-0 |
| 487 | Amino Acid | Ty1-like NLS Q767K9-0 |
| 488 | Amino Acid | Ty1-like NLS Q7YQM3-0 |
| 489 | Amino Acid | Ty1-like NLS Q7YQM4-0 |
| 490 | Amino Acid | Ty1-like NLS Q7YR38-0 |
| 491 | Amino Acid | Ty1-like NLS Q95KD7-0 |
| 492 | Amino Acid | Ty1-like NLS Q95LG8-0 |
| 493 | Amino Acid | Ty1-like NLS Q9N1Q7-0 |
| 494 | Amino Acid | Ty1-like NLS A2WSD3-0 |
| 495 | Amino Acid | Ty1-like NLS A2XVF7-0 |
| 496 | Amino Acid | Ty1-like NLS A2XVF7-1 |
| 497 | Amino Acid | Ty1-like NLS A2XVF7-2 |
| 498 | Amino Acid | Ty1-like NLS A2XVF7-3 |
| 499 | Amino Acid | Ty1-like NLS A3AVH5-0 |
| 500 | Amino Acid | Ty1-like NLS A3AVH5-1 |
| 501 | Amino Acid | Ty1-like NLS A3AVH5-2 |
| 502 | Amino Acid | Ty1-like NLS A3AVH5-3 |
| 503 | Amino Acid | Ty1-like NLS A4QJZ0-0 |
| 504 | Amino Acid | Ty1-like NLS A4QK78-0 |
| 505 | Amino Acid | Ty1-like NLS A4QKG5-0 |
| 506 | Amino Acid | Ty1-like NLS A4QKQ3-0 |
| 507 | Amino Acid | Ty1-like NLS A6MN03-0 |
| 508 | Amino Acid | Ty1-like NLS A8MS85-0 |
| 509 | Amino Acid | Ty1-like NLS A9XMT3-0 |
| 510 | Amino Acid | Ty1-like NLS B8YIE8-0 |
| 511 | Amino Acid | Ty1-like NLS F4HVZ5-0 |
| 512 | Amino Acid | Ty1-like NLS F4IQK5-0 |
| 513 | Amino Acid | Ty1-like NLS F4IQK5-1 |
| 514 | Amino Acid | Ty1-like NLS O22812-0 |
| 515 | Amino Acid | Ty1-like NLS O49323-0 |
| 516 | Amino Acid | Ty1-like NLS O64571-0 |
| 517 | Amino Acid | Ty1-like NLS O64639-0 |
| 518 | Amino Acid | Ty1-like NLS O64639-1 |
| 519 | Amino Acid | Ty1-like NLS O64639-2 |
| 520 | Amino Acid | Ty1-like NLS O65743-0 |
| 521 | Amino Acid | Ty1-like NLS O81072-0 |
| 522 | Amino Acid | Ty1-like NLS P09975-0 |
| 523 | Amino Acid | Ty1-like NLS P0C262-0 |
| 524 | Amino Acid | Ty1-like NLS P29345-0 |
| 525 | Amino Acid | Ty1-like NLS P50888-0 |
| 526 | Amino Acid | Ty1-like NLS P51269-0 |
| 527 | Amino Acid | Ty1-like NLS P51430-0 |
| 528 | Amino Acid | Ty1-like NLS Q06FP6-0 |
| 529 | Amino Acid | Ty1-like NLS Q06FP6-1 |
| 530 | Amino Acid | Ty1-like NLS Q06FP6-2 |
| 531 | Amino Acid | Ty1-like NLS Q06R72-0 |
| 532 | Amino Acid | Ty1-like NLS Q06R98-0 |
| 533 | Amino Acid | Ty1-like NLS Q1KVQ9-0 |
| 534 | Amino Acid | Ty1-like NLS Q1XDL7-0 |
| 535 | Amino Acid | Ty1-like NLS Q38873-0 |
| 536 | Amino Acid | Ty1-like NLS Q3E8X3-0 |
| 537 | Amino Acid | Ty1-like NLS Q3ZJ77-0 |
| 538 | Amino Acid | Ty1-like NLS Q42438-0 |
| 539 | Amino Acid | Ty1-like NLS Q4V3E0-0 |
| 540 | Amino Acid | Ty1-like NLS Q66GN2-0 |
| 541 | Amino Acid | Ty1-like NLS Q6K5K2-0 |
| 542 | Amino Acid | Ty1-like NLS Q6YS30-0 |
| 543 | Amino Acid | Ty1-like NLS Q84WK0-0 |
| 544 | Amino Acid | Ty1-like NLS Q84Y18-0 |
| 545 | Amino Acid | Ty1-like NLS Q8H991-0 |
| 546 | Amino Acid | Ty1-like NLS Q8RWY7-0 |
| 547 | Amino Acid | Ty1-like NLS Q8RWY7-1 |
| 548 | Amino Acid | Ty1-like NLS Q8VZ67-0 |
| 549 | Amino Acid | Ty1-like NLS Q8VZN4-0 |
| 550 | Amino Acid | Ty1-like NLS Q8W0K2-0 |
| 551 | Amino Acid | Ty1-like NLS Q8W490-0 |
| 552 | Amino Acid | Ty1-like NLS Q9CAE4-0 |
| 553 | Amino Acid | Ty1-like NLS Q9FMZ4-0 |
| 554 | Amino Acid | Ty1-like NLS Q9FMZ4-1 |
| 555 | Amino Acid | Ty1-like NLS Q9FRI0-0 |
| 556 | Amino Acid | Ty1-like NLS Q9LKI5-0 |
| 557 | Amino Acid | Ty1-like NLS Q9LUJ5-0 |
| 558 | Amino Acid | Ty1-like NLS Q9LUR0-0 |
| 559 | Amino Acid | Ty1-like NLS Q9LVU8-0 |
| 560 | Amino Acid | Ty1-like NLS Q9LVU8-1 |
| 561 | Amino Acid | Ty1-like NLS Q9LYK7-0 |
| 562 | Amino Acid | Ty1-like NLS Q9M020-0 |
| 563 | Amino Acid | Ty1-like NLS Q9M1L7-0 |
| 564 | Amino Acid | Ty1-like NLS Q9M3V8-0 |
| 565 | Amino Acid | Ty1-like NLS Q9SRQ3-0 |
| 566 | Amino Acid | Ty1-like NLS Q9ZPV5-0 |
| 567 | Amino Acid | Ty1-like NLS B1AQJ2-0 |
| 568 | Amino Acid | Ty1-like NLS D3ZUI5-0 |
| 569 | Amino Acid | Ty1-like NLS D4A666-0 |
| 570 | Amino Acid | Ty1-like NLS E1U8D0-0 |
| 571 | Amino Acid | Ty1-like NLS G3V8T1-0 |
| 572 | Amino Acid | Ty1-like NLS O35821-0 |
| 573 | Amino Acid | Ty1-like NLS O88487-0 |
| 574 | Amino Acid | Ty1-like NLS O88665-0 |
| 575 | Amino Acid | Ty1-like NLS P61364-0 |
| 576 | Amino Acid | Ty1-like NLS P61365-0 |
| 577 | Amino Acid | Ty1-like NLS P83858-0 |
| 578 | Amino Acid | Ty1-like NLS P83861-0 |
| 579 | Amino Acid | Ty1-like NLS Q00566-0 |
| 580 | Amino Acid | Ty1-like NLS Q05CL8-0 |
| 581 | Amino Acid | Ty1-like NLS Q09XV5-0 |
| 582 | Amino Acid | Ty1-like NLS Q3TFK5-0 |
| 583 | Amino Acid | Ty1-like NLS Q3TFK5-1 |
| 584 | Amino Acid | Ty1-like NLS Q3TFK5-2 |
| 585 | Amino Acid | Ty1-like NLS Q3TYA6-0 |
| 586 | Amino Acid | Ty1-like NLS Q3UMF0-0 |
| 587 | Amino Acid | Ty1-like NLS Q498U4-0 |
| 588 | Amino Acid | Ty1-like NLS Q4V7C4-0 |
| 589 | Amino Acid | Ty1-like NLS Q4V8G7-0 |
| 590 | Amino Acid | Ty1-like NLS Q505I5-0 |
| 591 | Amino Acid | Ty1-like NLS Q562C7-0 |
| 592 | Amino Acid | Ty1-like NLS Q566R3-0 |
| 593 | Amino Acid | Ty1-like NLS Q566R3-1 |

TABLE 3-continued

| SEQ ID NO | Type | Description |
|---|---|---|
| 594 | Amino Acid | Ty1-like NLS Q566R3-2 |
| 595 | Amino Acid | Ty1-like NLS Q58A65-0 |
| 596 | Amino Acid | Ty1-like NLS Q5NBX1-0 |
| 597 | Amino Acid | Ty1-like NLS Q5XG71-0 |
| 598 | Amino Acid | Ty1-like NLS Q5XI01-0 |
| 599 | Amino Acid | Ty1-like NLS Q5XIB5-0 |
| 600 | Amino Acid | Ty1-like NLS Q5XIR6-0 |
| 601 | Amino Acid | Ty1-like NLS Q60848-0 |
| 602 | Amino Acid | Ty1-like NLS Q62018-0 |
| 603 | Amino Acid | Ty1-like NLS Q62018-1 |
| 604 | Amino Acid | Ty1-like NLS Q62187-0 |
| 605 | Amino Acid | Ty1-like NLS Q62871-0 |
| 606 | Amino Acid | Ty1-like NLS Q63520-0 |
| 607 | Amino Acid | Ty1-like NLS Q642C0-0 |
| 608 | Amino Acid | Ty1-like NLS Q68SB1-0 |
| 609 | Amino Acid | Ty1-like NLS Q6AYK5-0 |
| 610 | Amino Acid | Ty1-like NLS Q6NZB0-0 |
| 611 | Amino Acid | Ty1-like NLS Q76KJ5-0 |
| 612 | Amino Acid | Ty1-like NLS Q76KJ5-1 |
| 613 | Amino Acid | Ty1-like NLS Q76KJ5-2 |
| 614 | Amino Acid | Ty1-like NLS Q78WZ7-0 |
| 615 | Amino Acid | Ty1-like NLS Q78WZ7-1 |
| 616 | Amino Acid | Ty1-like NLS Q7TNB4-0 |
| 617 | Amino Acid | Ty1-like NLS Q7TPV4-0 |
| 618 | Amino Acid | Ty1-like NLS Q80WC1-0 |
| 619 | Amino Acid | Ty1-like NLS Q80Z37-0 |
| 620 | Amino Acid | Ty1-like NLS Q811R2-0 |
| 621 | Amino Acid | Ty1-like NLS Q8BKA3-0 |
| 622 | Amino Acid | Ty1-like NLS Q8CJ67-0 |
| 623 | Amino Acid | Ty1-like NLS Q8K214-0 |
| 624 | Amino Acid | Ty1-like NLS Q8K4T4-0 |
| 625 | Amino Acid | Ty1-like NLS Q8R5F3-0 |
| 626 | Amino Acid | Ty1-like NLS Q91X13-0 |
| 627 | Amino Acid | Ty1-like NLS Q9CS72-0 |
| 628 | Amino Acid | Ty1-like NLS Q9CVI2-0 |
| 629 | Amino Acid | Ty1-like NLS Q9CWX9-0 |
| 630 | Amino Acid | Ty1-like NLS Q9CZX5-0 |
| 631 | Amino Acid | Ty1-like NLS Q9D1J3-0 |
| 632 | Amino Acid | Ty1-like NLS Q9D3V1-0 |
| 633 | Amino Acid | Ty1-like NLS Q9DBQ9-0 |
| 634 | Amino Acid | Ty1-like NLS Q9JIX5-0 |
| 635 | Amino Acid | Ty1-like NLS Q9JJ80-0 |
| 636 | Amino Acid | Ty1-like NLS Q9JJ89-0 |
| 637 | Amino Acid | Ty1-like NLS Q9R1C7-0 |
| 638 | Amino Acid | Ty1-like NLS Q9R1X4-0 |
| 639 | Amino Acid | Ty1-like NLS Q9Z180-0 |
| 640 | Amino Acid | Ty1-like NLS Q9Z207-0 |
| 641 | Amino Acid | Ty1-like NLS Q9Z2D6-0 |
| 642 | Amino Acid | Ty1-like NLS A0A1L8GSA2-0 |
| 643 | Amino Acid | Ty1-like NLS A0JP82-0 |
| 644 | Amino Acid | Ty1-like NLS A1A5I1-0 |
| 645 | Amino Acid | Ty1-like NLS A1L2T6-0 |
| 646 | Amino Acid | Ty1-like NLS A2RUV0-0 |
| 647 | Amino Acid | Ty1-like NLS A9JRD8-0 |
| 648 | Amino Acid | Ty1-like NLS E7F568-0 |
| 649 | Amino Acid | Ty1-like NLS F1QFU0-0 |
| 650 | Amino Acid | Ty1-like NLS F1QWK4-0 |
| 651 | Amino Acid | Ty1-like NLS K9JHZ4-0 |
| 652 | Amino Acid | Ty1-like NLS P07193-0 |
| 653 | Amino Acid | Ty1-like NLS P0CB65-0 |
| 654 | Amino Acid | Ty1-like NLS P12957-0 |
| 655 | Amino Acid | Ty1-like NLS P13505-0 |
| 656 | Amino Acid | Ty1-like NLS P21783-0 |
| 657 | Amino Acid | Ty1-like NLS Q28BS0-0 |
| 658 | Amino Acid | Ty1-like NLS Q28BS0-1 |
| 659 | Amino Acid | Ty1-like NLS Q28G05-0 |
| 660 | Amino Acid | Ty1-like NLS Q32N87-0 |
| 661 | Amino Acid | Ty1-like NLS Q3KPW4-0 |
| 662 | Amino Acid | Ty1-like NLS Q4QR29-0 |
| 663 | Amino Acid | Ty1-like NLS Q4QR29-1 |
| 664 | Amino Acid | Ty1-like NLS Q5BL56-0 |
| 665 | Amino Acid | Ty1-like NLS Q5XJK9-0 |
| 666 | Amino Acid | Ty1-like NLS Q5ZIJ0-0 |
| 667 | Amino Acid | Ty1-like NLS Q640I9-0 |
| 668 | Amino Acid | Ty1-like NLS Q6DEU9-0 |
| 669 | Amino Acid | Ty1-like NLS Q6DEU9-1 |
| 670 | Amino Acid | Ty1-like NLS Q6DEU9-2 |
| 671 | Amino Acid | Ty1-like NLS Q6DK85-0 |
| 672 | Amino Acid | Ty1-like NLS Q6DRI7-0 |
| 673 | Amino Acid | Ty1-like NLS Q6DRL5-0 |
| 674 | Amino Acid | Ty1-like NLS Q6NV26-0 |
| 675 | Amino Acid | Ty1-like NLS Q6NWI1-0 |
| 676 | Amino Acid | Ty1-like NLS Q6NYJ3-0 |
| 677 | Amino Acid | Ty1-like NLS Q6P4K1-0 |
| 678 | Amino Acid | Ty1-like NLS Q6WKW9-0 |
| 679 | Amino Acid | Ty1-like NLS Q7ZUF2-0 |
| 680 | Amino Acid | Ty1-like NLS Q7ZW47-0 |
| 681 | Amino Acid | Ty1-like NLS Q7ZXZ0-0 |
| 682 | Amino Acid | Ty1-like NLS Q7ZXZ0-1 |
| 683 | Amino Acid | Ty1-like NLS Q7ZYR8-0 |
| 684 | Amino Acid | Ty1-like NLS Q8AVQ6-0 |
| 685 | Amino Acid | Ty1-like NLS Q9DE07-0 |
| 686 | Amino Acid | Ty1-like NLS P03086-0 |
| 687 | Amino Acid | Ty1-like NLS P09814-0 |
| 688 | Amino Acid | Ty1-like NLS P0CK10-0 |
| 689 | Amino Acid | Ty1-like NLS P15075-0 |
| 690 | Amino Acid | Ty1-like NLS P51724-0 |
| 691 | Amino Acid | Ty1-like NLS P52344-0 |
| 692 | Amino Acid | Ty1-like NLS P52531-0 |
| 693 | Amino Acid | Ty1-like NLS Q5UP41-0 |
| 694 | Amino Acid | Ty1-like NLS Q9DUC0-0 |
| 695 | Amino Acid | Ty1-like NLS Q9XJS3-0 |
| 696 | Amino Acid | dPspCas13b-CPSF30 fusion |
| 697 | Amino Acid | dPspCas13b-WDR33 fusion |
| 698 | Amino Acid | dPspCas13b- NUDT21 fusion |
| 699 | Amino Acid | HlightR Green |
| 700 | Amino Acid | HlightR Red |
| 701 | Amino Acid | HiLightR-S11 |
| 702 | Amino Acid | EraseR |
| 703 | Amino Acid | MBNL1 |
| 704 | Amino Acid | mCherry-MBNL1 |
| 705 | Nucleic Acid | PspCas13b |
| 706 | Nucleic Acid | PspCas13b Truncation |
| 707 | Nucleic Acid | dPspCas13b |
| 708 | Nucleic Acid | dPspCas13b truncation |
| 709 | Nucleic Acid | CPSF30 |
| 710 | Nucleic Acid | WDR33 |
| 711 | Nucleic Acid | NUDT21 |
| 712 | Nucleic Acid | Worm NudT21 |
| 713 | Nucleic Acid | Fly NudT21 |
| 714 | Nucleic Acid | Human NUDT21 Truncation Mutant |
| 715 | Nucleic Acid | NUDT21 R63S |
| 716 | Nucleic Acid | NUDT21 F103A |
| 717 | Nucleic Acid | NudT21 Tandem Dimer |
| 718 | Nucleic Acid | eGFP |
| 719 | Nucleic Acid | mCherry |
| 720 | Nucleic Acid | 7xS11 |
| 721 | Nucleic Acid | sfGFP |
| 722 | Nucleic Acid | Linker sequence 1 |
| 723 | Nucleic Acid | 3xFlag |
| 724 | Nucleic Acid | Ty1 NLS |
| 725 | Nucleic Acid | dPspCas13b-CPSF30 fusion |
| 726 | Nucleic Acid | dPspCas13b-WDR33 fusion |
| 727 | Nucleic Acid | dPspCas13b- NUDT21 fusion |
| 728 | Nucleic Acid | HlightR Green |
| 729 | Nucleic Acid | HlightR Red |
| 730 | Nucleic Acid | HiLightR-S11 |
| 731 | Nucleic Acid | EraseR |
| 732 | Nucleic Acid | 3' RACE clone isolated from Postscriptr-targeted sfGFPapa reporter |
| 733 | Nucleic Acid | 3' RACE clone isolated from Postscriptr-targeted sfGFPapa reporter |
| 734 | Nucleic Acid | 3' RACE clone isolated from Postscriptr-targeted sfGFPapa reporter |
| 735 | Nucleic Acid | 3' RACE clone isolated from Postscriptr-targeted sfGFPapa reporter |
| 736 | Nucleic Acid | 3' RACE clone isolated from Postscriptr-targeted sfGFPapa reporter |
| 737 | Nucleic Acid | 3' RACE clone isolated from Postscriptr-targeted sfGFPapa reporter |
| 738 | Nucleic Acid | 3' RACE clone isolated from Postscriptr-targeted sfGFPapa reporter |
| 739 | Nucleic Acid | 3' RACE clone isolated from Postscriptr-targeted sfGFPapa reporter |
| 740 | Nucleic Acid | 3' RACE clone isolated from Postscriptr-targeted sfGFPapa reporter |

TABLE 3-continued

| SEQ ID NO | Type | Description |
|---|---|---|
| 741 | Nucleic Acid | 3' RACE clone isolated from Postscriptr-targeted sfGFPapa reporter |
| 742 | Nucleic Acid | 3' RACE clone isolated from Postscriptr-targeted sfGFPapa reporter |
| 743 | Nucleic Acid | 3' RACE clone isolated from Postscriptr-targeted sfGFPapa reporter |
| 744 | Nucleic Acid | sfGFPapa intronic crRNA target sequence |
| 745 | Nucleic Acid | Human SREBP1 intronic PAS crRNA target sequence |
| 746 | Nucleic Acid | 3' RACE Oligo d(T) |
| 747 | Nucleic Acid | 3' RACE Oligo dT Nested Primer 1 |
| 748 | Nucleic Acid | 3' RACE Oligo dT Nested Primer 2 |
| 749 | Nucleic Acid | 3' RACE SREBP1 Gene Specific Primer 1 |
| 750 | Nucleic Acid | 3' RACE SREBP1 Gene Specific Primer 2 |
| 751 | Nucleic Acid | 3' RACE sfGFPapa Gene Specific Primer 1 |
| 752 | Nucleic Acid | 3' RACE sfGFPapa Gene Specific Primer 2 |
| 753 | Nucleic Acid | SREBP1 upstream qRT-PCT F Primer |
| 754 | Nucleic Acid | SREBP1 upstream qRT-PCT R Primer |
| 755 | Nucleic Acid | SREBP1 downstream qRT-PCT F Primer |
| 756 | Nucleic Acid | SREBP1 downstream qRT-PCT R Primer |
| 757 | Nucleic Acid | LDLR qRT-PCT F Primer |
| 758 | Nucleic Acid | LDLR qRT-PCT R Primer |
| 759 | Nucleic Acid | sfGFPapa reporter |
| 760 | Nucleic Acid | MBNL1 |
| 761 | Nucleic Acid | mCherry-MBNL1 |
| 762 | Nucleic Acid | PspCas13b crRNA target sequence CASx9 |
| 763 | Nucleic Acid | PspCas13b crRNA target sequence CASx9-f2 |
| 764 | Nucleic Acid | PspCas13b crRNA target sequence CASx9-f3 |
| 765 | Nucleic Acid | Primer PspCas13b_A133H |
| 766 | Nucleic Acid | Primer PspCas13b_A1058H |
| 767 | Nucleic Acid | sfCherryapa Reporter |
| 768 | Nucleic Acid | sfGFP crRNA target sequence vector |
| 769 | Nucleic Acid | sfGFP crRNA target sequence −4 |
| 770 | Nucleic Acid | sfGFP crRNA target sequence −6 |
| 771 | Nucleic Acid | sfGFP crRNA target sequence +6 |
| 772 | Nucleic Acid | sfGFP crRNA target sequence +9 |
| 773 | Nucleic Acid | sfGFP crRNA target sequence +16 |
| 774 | Nucleic Acid | SREBP1 |
| 775 | Nucleic Acid | SREBP1Δ |
| 776 | Nucleic Acid | Postscriptr-induced polyadenylated transcript |
| 777 | Nucleic Acid | SREBP1C-PS |
| 778 | Nucleic Acid | PspCas13b crRNA direct repeat sequence |
| 779 | Nucleic Acid | BzoCas13b crRNA direct repeat sequence |
| 780 | Nucleic Acid | PbTCas13b crRNA direct repeat sequence |
| 781 | Nucleic Acid | PspCas13b crRNA sequence |
| 782 | Nucleic Acid | PspCas13b crRNA direct repeat sequence T17C |
| 783 | Nucleic Acid | PspCas13b crRNA direct repeat sequence T18C |
| 784 | Nucleic Acid | PspCas13b crRNA direct repeat sequence T19C |
| 785 | Nucleic Acid | DMPK CUG Exp |
| 786 | Nucleic Acid | CUG exp |
| 787 | Nucleic Acid | CAGx9 crRNA |
| 788 | Nucleic Acid | CUGx17 |
| 789 | Nucleic Acid | conserved consensus PAS |

EXPERIMENTAL EXAMPLES

The invention is further described in detail by reference to the following experimental examples. These examples are provided for purposes of illustration only and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the present invention and practice the claimed methods. The following working examples therefore, specifically point out certain embodiments of the present invention, and are not to be construed as limiting in any way the remainder of the disclosure.

Example 1: Targeted Cleavage and Polyadenylation of RNA by CRISPR-Cas13

The data presented herein demonstrates that fusion of catalytically dead Cas13 to a single mammalian polyadenylation factor, Nudix Hydrolase 21 (NUDT21), allows for site-specific CRISPR-Cas13-guided cleavage and polyadenylation of RNA in mammalian cells. This approach is termed Postscriptr and can be utilized for the non-genomic manipulation of gene expression and may have potential future therapeutic applications for treating human RNA processing diseases.

The 3' site of RNA cleavage and addition of a poly(A) tail is precisely determined by intrinsic polyadenylation signal (PAS) sequences typically composed of a canonical hexamer motif AAUAAA and upstream and downstream sequence elements (USE and DSE, respectively) (Tian & Graber, Wiley Interdiscip Rev RNA, 2012, 3:385-396). The AAUAAA PAS motif is typically found ~25 nucleotides upstream of the RNA cleavage site and is directly bound by two components of the cleavage and polyadenylation specific factor (CPSF) complex: cleavage and polyadenylation factor 30 (CPSF30) and WD repeat-containing protein 33 (WDR33) (Chan et al., Genes Dev, 2014, 28:2370-2380). Components of the cleavage factor Im (CFIm) complex bind directly to the USE motif UGUA which occurs ~50 nucleotides upstream of the RNA cleavage site (Ellkon et al., Nat Rev Genet, 2013, 14:496-506). In transcripts that lack the canonical AAUAAA motif, the CFIm complex functions as the primary determinant of poly(A) signal recognition (Venkataraman et al., Genes Dev, 2005, 19:1315-1327). Nudix Hydrolase 21 (NUDT21/CPSF5), the RNA binding component of the CFIm complex, functions as an activator of 3' end processing and regulator of alternative polyadenylation site choice (Zhu et al., Mol Cell, 2018, 69:62-74). Binding of the CFIm complex is among the first steps in 3' end processing and functions to recruit additional co-factors to the 3' end processing machinery. Direct interactions between components of the polyadenylation supercomplex and the C-terminal domain of RNA polymerase II trigger the disassembly of the elongation complex and coordinate 3' end processing with transcription termination (Zhao et al., Microbiol Mol Biol Rev, 1999, 63:405-45).

Cas13 is a bacterial-derived crRNA-guided endonuclease with a specific affinity for RNA (Abudayyeh et al., Science, 2016, 353:aaf5573). Similar to Cas9, mutation of residues within the nuclease domains of Cas13 generates a catalytically dead enzyme but retains RNA binding affinity (dCas13). Recently, fusion of dCas13 to mammalian RNA modifying enzymes has been shown to be useful for manipulating RNA in mammalian cells (Abudayyeh et al., Nature, 2017, 550:280-84; Cox et al., Science, 2017, 358:1019-27; O'Connell, J Mol Biol, 2019, 431:66-87). To direct polyadenylation complex formation using dCas13, three fusion proteins were designed combining the catalytically dead PspCas13b (dPspCas13b) with RNA binding components of the human 3' end processing machinery, including CPSF30, WDR33, and NUDT21 (FIG. 1A). An N-terminal 3×FLAG epitope tag was included for protein detection and a long flexible amino acid peptide linker [GGGGSGGGGS (SEQ ID NO:69)] between dPspCas13b and the polyadenylation components to reduce the likelihood of steric hindrance.

Unlike RNA modifying applications utilizing dCas13 which occur in the cytosol, post-transcriptional cleavage and polyadenylation of RNA occurs within the eukaryotic nucleus and therefore requires efficient nuclear localization of dCas13 fusion proteins. The large size of Cas13 and its lack of intrinsic nuclear localization signals (NLSs) could prevent efficient nuclear localization in mammalian cells. Consistent with this, the dPspCas13b fusion proteins lacking a mammalian NLS were retained in the cytoplasm when expressed in mammalian COS7 cells, as detected by immunocytochemistry using an anti-FLAG antibody (FIG. 5). Surprisingly, the addition of a classical SV40 NLS or bipartite NLS from nucleoplasmin (NPM) were both insufficient to promote nuclear localization of the dPspCas13b fusion proteins (FIG. 5). However, the addition of a single copy of the non-classical bipartite NLS derived from the yeast Ty1 retrotransposon, which utilizes normal cellular import machinery but contains a linker sequence nearly three times as long as a typical bipartite NLS (McLane et al., NAR, 2008, 36:4317-26; Kenna et al., Mol Cell Biol, 1998, 18:1115-24), resulted in robust nuclear localization of all three dPspCas13b fusion proteins (FIG. 1B).

Figure 6:
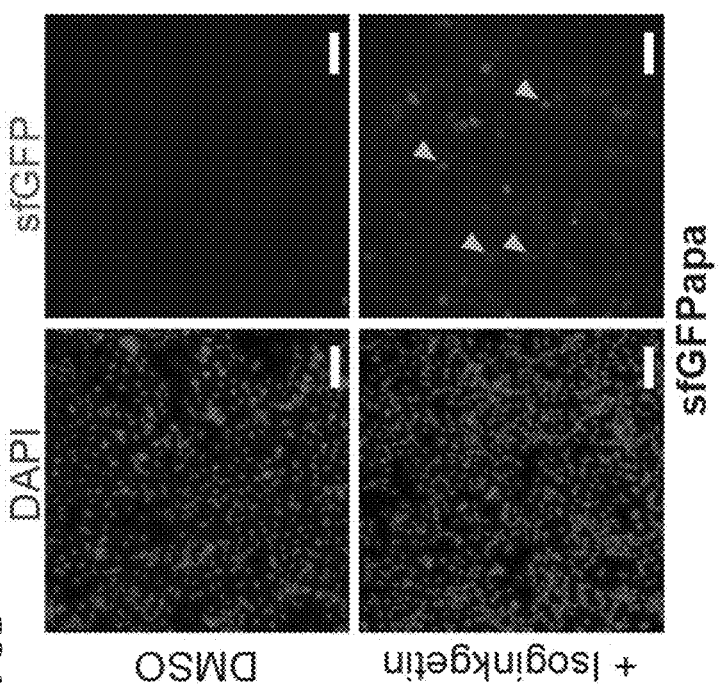
FIG. 6A and FIG. 6B, depicts experimental results demonstrating that inhibiting splicing promotes expression of the sfGFP(1-10)-L-(11) open reading frame.

Next, a reporter gene was designed to detect alternative cleavage and polyadenylation in mammalian cells capable of switching between fluorescent and non-fluorescent open reading frames of superfolder GFP (sfGFP) (FIG. 2). sfGFP forms a beta barrel comprised of 11 antiparallel beta strands, which can tolerate sequence insertions between the $10^{th}$ and $11^{th}$ beta strands but loses fluorescence if the $11^{th}$ beta strand is removed (Kamiyama et al., Nat Commun, 2016, 7:11046; Feng et al., Nat Commun, 2017, 8:370). A sfGFP reporter construct was generated with the coding sequence for the $11^{th}$ beta strand embedded within a prototypical mammalian intron (second intron of the rabbit beta globin gene) (sfGFPapa) (FIG. 2A). The coding sequence of the $11^{th}$ beta strand was designed in-frame with the upstream sfGFP coding sequence so that translation of the proximal open reading frame would encode a complete sfGFP sequence, albeit with a 14 amino acid linker sequence between the $10^{th}$ and $11^{th}$ beta strand resulting from translation of the intervening intronic sequence [sfGFP(1-10)-L-11]. Expression of the sfGFPapa reporter in mammalian COST cells resulted in almost no detectable fluorescence, suggesting efficient removal of the intron containing the $11^{th}$ beta strand and translation of the open reading frame encoding the non-fluorescent sfGFP(1-10) protein (FIG. 2B to FIG. 2D). However, cells expressing the sfGFPapa reporter treated with the splicing inhibitor isoginkgetin (O'Brien et al., J Biol Chem, 2008, 283:33147-54) resulted in detectable green fluorescence after 24 hours, demonstrating that the modified sfGFP open reading frame containing the linker between the $10^{th}$ and $11^{th}$ beta strands is functional (FIG. 6A and FIG. 6B). Insertion of an SV40 polyadenylation cassette downstream of coding sequence for the $11^{th}$ beta strand of sfGFP (sfGFPapa-pA) resulted in robust green fluorescence, demonstrating that intronic cleavage and polyadenylation of the sfGFPapa reporter promotes utilization of the functional sfGFP(1-10)-L-11 open reading frame (FIG. 2E to 2H). Together, these data demonstrate that the sfGFPapa reporter gene encodes both functional and non-functional open reading frames which can be switched in response to changes in splicing or intronic cleavage and polyadenylation.

Figure 7:
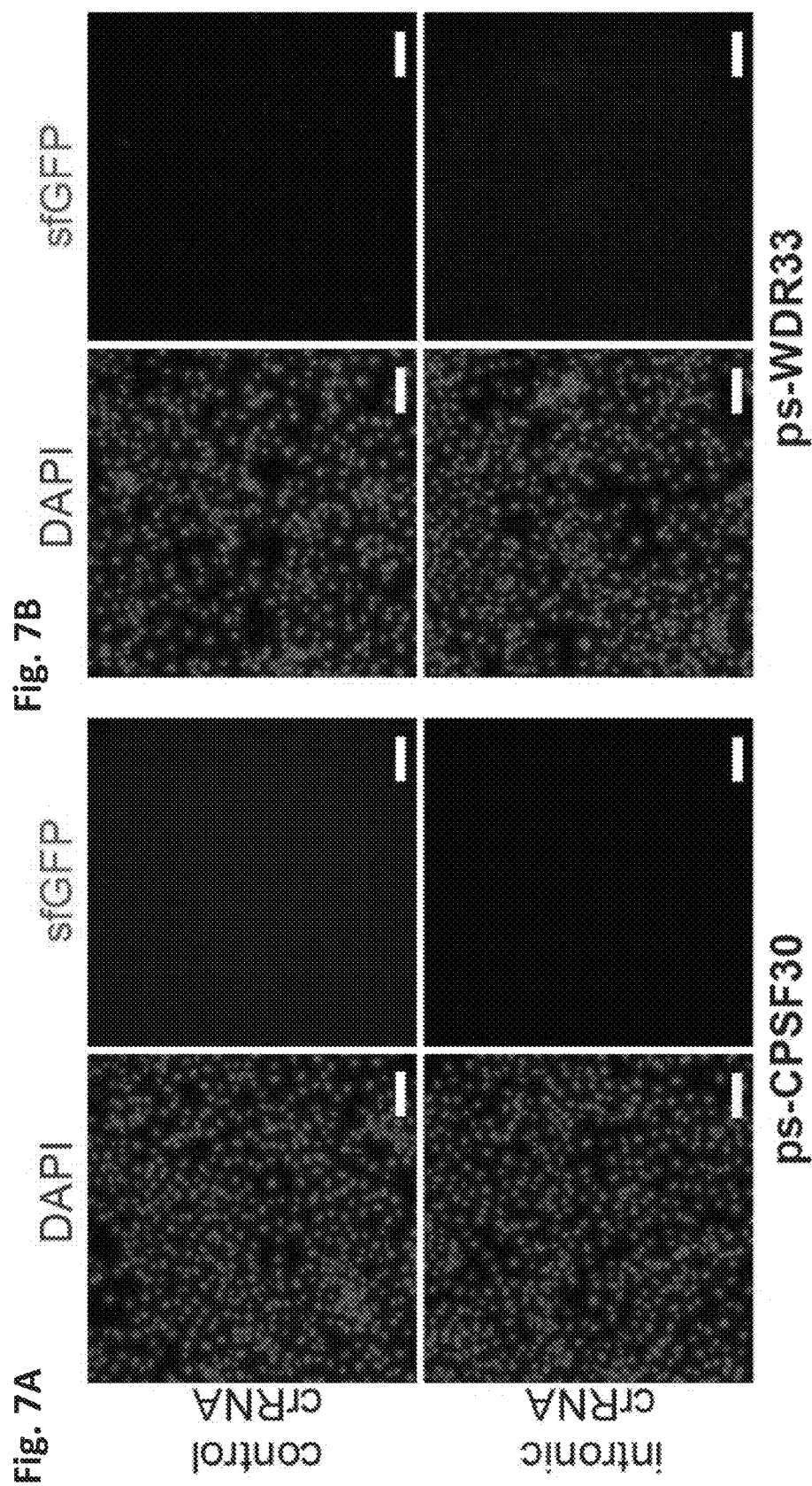
FIG. 7, comprising

To determine whether the dPspCas13b fusion proteins could promote CRISPR-Cas13-mediated cleavage and polyadenylation of the sfGFPapa reporter mRNA, a crRNA was designed targeting an intronic sequence downstream of the coding sequence of the $11^{th}$ beta strand of sfGFP in the sfGFPapa reporter (FIG. 3A). In live cell assays, no fluorescence signal was detected in cells expressing any of the dPspCas13b fusion proteins using a non-targeting crRNA, relative to the sfGFPapa reporter alone (FIG. 3B and FIG. 7). However, expression of the intron targeting crRNA with the dPspCas13b-NUDT21 fusion protein, but not the CPSF30 or WDR33 fusions proteins, resulted in detectable green fluorescent cells after 24 hours (FIG. 3B and FIG. 7).

3' rapid amplification of cDNA ends (3' RACE) was performed to determine whether the fluorescence signal was due to CRISPR-Cas13-mediated targeted cleavage and polyadenylation of the sfGFPapa reporter mRNA. RACE compatible cDNA was generated from total RNA using a poly(T) oligonucleotide containing two 5' nested primer sequences. Using two nested reporter specific primers upstream of the crRNA target sequence, a high molecular weight band was detected corresponding to the predicted size of the sfGFPapa pre-mRNA transcript for both samples (FIG. 3C). Interestingly, in cells targeted with the intronic crRNA, an additional broad band of smaller RACE products was detected, suggesting that cleavage and polyadenylation may have occurred near the targeted crRNA sequence (FIG. 3C and FIG. 3D). To determine the sequence of the 3' RACE products, the 200-500 base pair region was gel purified and subcloned using TOPO TA cloning. 11 unique clones were isolated and sequenced which revealed that sfGFPapa mRNAs were cleaved and polyadenylated at sites ranging from −7 to +110 nucleotides relative to the 3' side of the crRNA target sequence (FIG. 3E). In contrast to mammalian cleavage which occurs primarily after a CA dinucleotide, Postscriptr-induced cleavage most often occurred at a C or T nucleotide (FIG. 3F). Interestingly, four of the 11 clones showed a 3' addition of non-templated nucleotides prior to poly (A) tail elongation, which is thought to be rare in mammalian species but prevalent in plant mRNAs (Jin & Bian, R N A, 2004, 10:1695-97). These data demonstrate that the dPspCas13b-NUDT21 fusion protein was sufficient to induce cleavage and polyadenylation of a reporter mRNA at an intronic sequence targeted by a crRNA.

Figure 8:
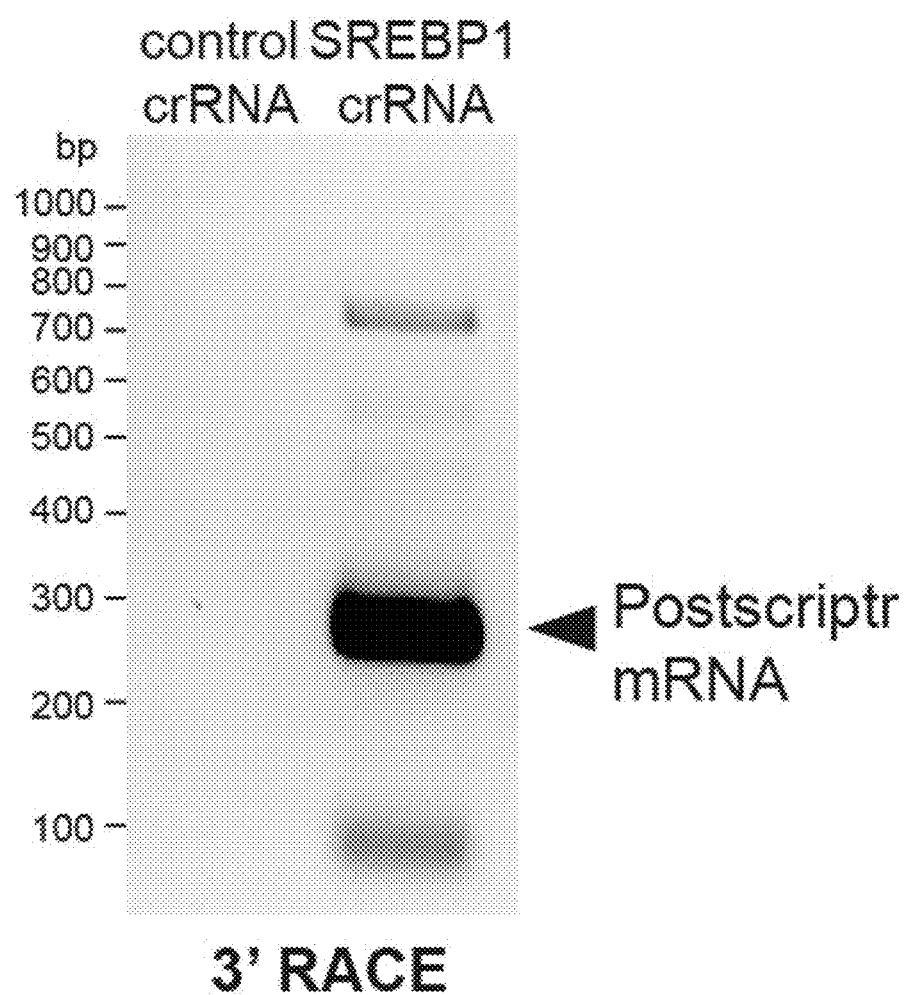
FIG. 8 depicts experimental results demonstrating Postscriptr-mediated alternative cleavage and polyadenylation of human SREBP1 transcripts. PCR amplified 3'RACE products from cells expressing dPspCas13b-NUDT21 with a non-targeting control or SREBP1-targeting crRNAs.

To determine whether Postscriptr could promote alternative cleavage and polyadenylation of an endogenously expressed human mRNA, transcripts encoding the human sterol regulatory element binding protein 1 (SREBP1) were targeted. SREBP1 is a ubiquitously expressed transcription factor which transactivates genes that contain sterol regulatory elements (SREs) and encode proteins controlling lipid synthesis and uptake, such as the low-density lipoprotein receptor (LDLR) (FIG. 4) (Horton et al., J Clin Invest, 2002, 109:1125-31). SREBP1 is first synthesized as a transcriptionally inactive precursor protein anchored within the membrane of the endoplasmic reticulum (ER) (Brown & Goldstein, Cell, 1997, 89:331-40) (FIG. 4A). In sterol depleted cells, proteolytic cleavage of SREBP1 by S2P liberates an N-terminal DNA-binding fragment that allows SREBP1 to enter the nucleus and activate gene transcription (Brown et al., Cell, 2000, 100:391-98) (FIG. 4A). SREBP1 transcripts in the liver can utilize an endogenous intronic PAS and generate a protein fragment terminated at a site adjacent to the transcriptionally active S2P cleavage product [SREBP1aΔ, AB373958; SREBP1cΔ, AB373959] (FIGS. 4B and C). Next, it was determined whether Postscriptr could promote the utilization of the SREBP1 intronic PAS in a non-liver cell line and upregulate SREBP1 target gene expression. The dPspCas13b-NUDT21 fusion protein was co-expressed with either an SREBP1-targeting or non-targeting crRNA in human HEK293T cells (FIG. 4D). Performing 3' RACE, a strong band was detected corresponding to the approximate size of the predicted 3'RACE product in cells transfected with the SREBP1-targeting crRNA, and no bands were detected in cells transfected with the control crRNA (FIG. 8). Direct sequencing of this 3' RACE product revealed that SREBP1 transcripts were cleaved and polyadenylated 71 nucleotides downstream of the crRNA target sequence and that splicing of the terminal exon was inhibited (FIGS. 4D and E). Cleavage occurred at a CA dinucleotide 36 nucleotides downstream of the reported cleavage site in humans and generated an open reading frame which terminated at a stop codon within the retained intron sequence, adding an additional 16 amino acids to the C-terminus of SREBP1 (FIGS. 4E and F). Gene expression analyses in a mixed population of SREBP1-targeted and non-targeted HEK293T cells showed that the overall SREBP1 transcript levels were unchanged when using qRT-PCR and PCR primers upstream of the crRNA target sequence (FIG. 4G). However, primers spanning the targeted exon showed a significant decrease in SREBP1 transcript levels in targeted versus non-targeted cells, suggesting that transcription termination may be coupled with Postscriptr-mediated cleavage and polyadenylation (FIG. 4H). Interestingly, in SREBP1-targeted cells, a significant increase in transcript levels of the well-characterized SREBP1-responsive gene, LDLR, was further detected (FIG. 4I).

In conclusion, the date presented herein demonstrates the development of a unique CRISPR-Cas13 RNA modifying technology to induce sequence-specific cleavage and polyadenylation of RNA in mammalian cells. This approach utilizes a dPspCas13b-NUDT21 fusion protein, which, as demonstrated herein, requires a non-classical bipartite NLS for nuclear localization in mammalian cells. The data presented herein demonstrates that the dPspCas13b-NUDT21 fusion protein was sufficient to promote cleavage and polyadenylation at an intronic sequence within a novel gain-of-function fluorescent reporter, sfGFPapa. The ability of Postscriptr to promote cleavage and polyadenylation of the sfGFPapa reporter was striking, given that the second intron of the rabbit beta globin gene does not contain any known endogenous PAS sequences. These findings demonstrate that the dPspCas13b-NUDT21 fusion protein can independently facilitate the recruitment of a functional 3' end processing complex at a crRNA targeted sequence. These findings support the role of NUDT21 as an emerging master regulator of cleavage and alternative polyadenylation site choice in mammals (Zhu et al., Mol Cell, 2018, 69:62-74; Brumbaugh et al., Cell, 2018, 172:106-120; Sartini et al., Biol Reprod, 2008, 89:472-82).

It is currently unclear why fusion of dPspCas13b to either CPSF30 or WDR33 were not sufficient to promote cleavage and polyadenylation of the sfGFPapa reporter in these assays. Since both CPSF30 and WDR33 have been shown to make direct contacts with the AAUAAA PAS motif, one possibility may be a requirement of the PAS RNA to promote ternary complex formation. Alternatively, tethering of CPSF30 and WDR33 may be insufficient to induce 3' end processing, a possibility consistent with data showing that insertion of a minimal synthetic PAS (including an AAUAAA motif and downstream sequence elements) within the second intron of a rabbit beta globin gene reporter was insufficient to promote intronic cleavage and polyadenylation (Levitt et al., Genes Dev, 1989 3:1019-25).

It is also demonstrated herein that Postscriptr can direct cleavage and polyadenylation at an endogenous intronic PAS of the human SREBP1 gene. It is currently unclear why a single primary cleavage site was induced when targeting the endogenous SREBP1 intronic PAS, yet a range of cleavage products spanning ~100 nucleotides were induced when targeting the sfGFPapa reporter. While not wishing to be bound to any particular theory, it is possible that the lack of intrinsic PAS sequences within the second intron of the rabbit beta globin gene in the sfGFPapa reporter may be required to help guide cleavage site specificity. Future studies are necessary to delineate the minimal upstream and downstream sequence elements which may enhance Postscriptr targeting at ectopic target sites.

While the endonuclease activity of Cas13 is highly effective for gene knockdown in mammalian cells (Abudayyeh et al., Nature, 2017, 550:280-84), Postscriptr technology allows for a unique approach to manipulate RNA in cells which may be useful for the study of 3' end RNA processing and for the manipulation of endogenous gene expression. One interesting example would be the interrogation of lncRNA function, many of which control gene expression through recruitment of chromatin modifying complexes or by establishing permissive local chromatin environments (Anderson et al., Nature, 2016, 539:433-36; Joung et al., Nature, 2017, 5448:343-46; Engreitz et al., Nautre, 2016, 539:452-55; Rinn & Chang, Annu Rev Biochem, 2012, 81:145-66). Postscriptr-guided cleavage, polyadenylation, and transcriptional termination of lncRNAs could allow for the identification of functional lncRNA domains or functional genomic regions. In addition, a number of human diseases are the direct result of loss-of-function mutations within poly(A) signal sequences which can result in transcript elongation and mRNA stability and translation (Higgs et al., Nature, 1983, 306:398-400; Orkin et al., EMBO J, 1985, 4:453-56; Rund et al., PNAS, 1992, 89:4324-28). Here, the unique therapeutic application of Postscriptr technology may be useful for the correction of normal RNA cleavage and polyadenylation site choice in diseased tissues.

Synthetic DNA and Cloning

The coding sequences of human CPSF30, WDR33 and NUDT21 were designed and synthesized for assembly as gBlocks (IDT, Integrated DNA Technologies) and cloned as C-terminal fusions to dPspCas13b into a modified version of the CS2 mammalian expression vector containing a 5' T7 promoter (CSX). The sfGFPapa reporter was designed and synthesized as two separate gBlock gene fragments and subcloned into the CS2 mammalian expression vector. All plasmids coding sequences were fully verified by Sanger sequencing. Please see Example 3 for a list of coding sequences and reporter sequences.

Cell Lines, Transient Transfections and Drug Treatments

The COS7 cell line was maintained in DMEM supplemented with 10% Fetal Bovine Serum (FBS) with penicillin/streptomycin at 37° C. in an atmosphere of 5% $CO_2$. Cells were seeded and transiently transfected using Fugene6 (Promega) according to manufacturer's protocol. Twenty-hours after transfection, cells were either imaged, or treated with DMSO or Isoginkgetin and cultured for an additional 24 hours prior to imaging. For live cell imaging, cells were washed twice with DPBS, counterstained with 10 μg/ml Hoechst 33342 (Invitrogen) in DPBS for 10 minutes at room temperature and imaged on a ZOE Fluorescent Cell Imager (Bio-Rad).

Antibodies and Immunohistochemistry

Transiently transfected COS7 cells were fixed in 4% formaldehyde in PBS for 20 minutes, blocked in 3% Bovine Serum Albumin (BSA) and incubated with primary anti-FLAG (Sigma, F1864) at 1:1000 in 1% BSA for 1 hour at room temperature. Cells were subsequently incubated with an Alexa488 conjugated secondary antibody (Thermofisher)

in 1% BSA for 30 minutes at room temperature. Coverslips were mounted using anti-fade fluorescent mounting medium containing DAPI (Vector Biolabs, H-1200) and imaged with confocal microscopy.

3' Rapid Amplification of cDNA Ends (3' RACE)

Transfected cells were washed twice with DPBS and harvested in 1 ml of Trizol to isolate total RNA. RACE compatible cDNA was generated using SuperScript III (Invitrogen) according to manufacturer's protocol, with the exception of a custom oligo d(T) oligonucleotide containing two 5' nested primer sequences. RACE PCR was performed using two nested target gene specific primers and touchdown PCR protocol as follows: 94° C. for 1 minutes (1 cycle); 94° C. for 30 seconds, 72° C. for 1 minute (5 cycles); 94° C. for 30 seconds, 70° C. for 4 minutes (5 cycles); 94° C. for 20 seconds, 68° C. for 1 minute (25 cycles); 72° C. for 5 minutes. Please see Example 3 for a list of PCR primers and 3'RACE specific primers.

Figure 9:
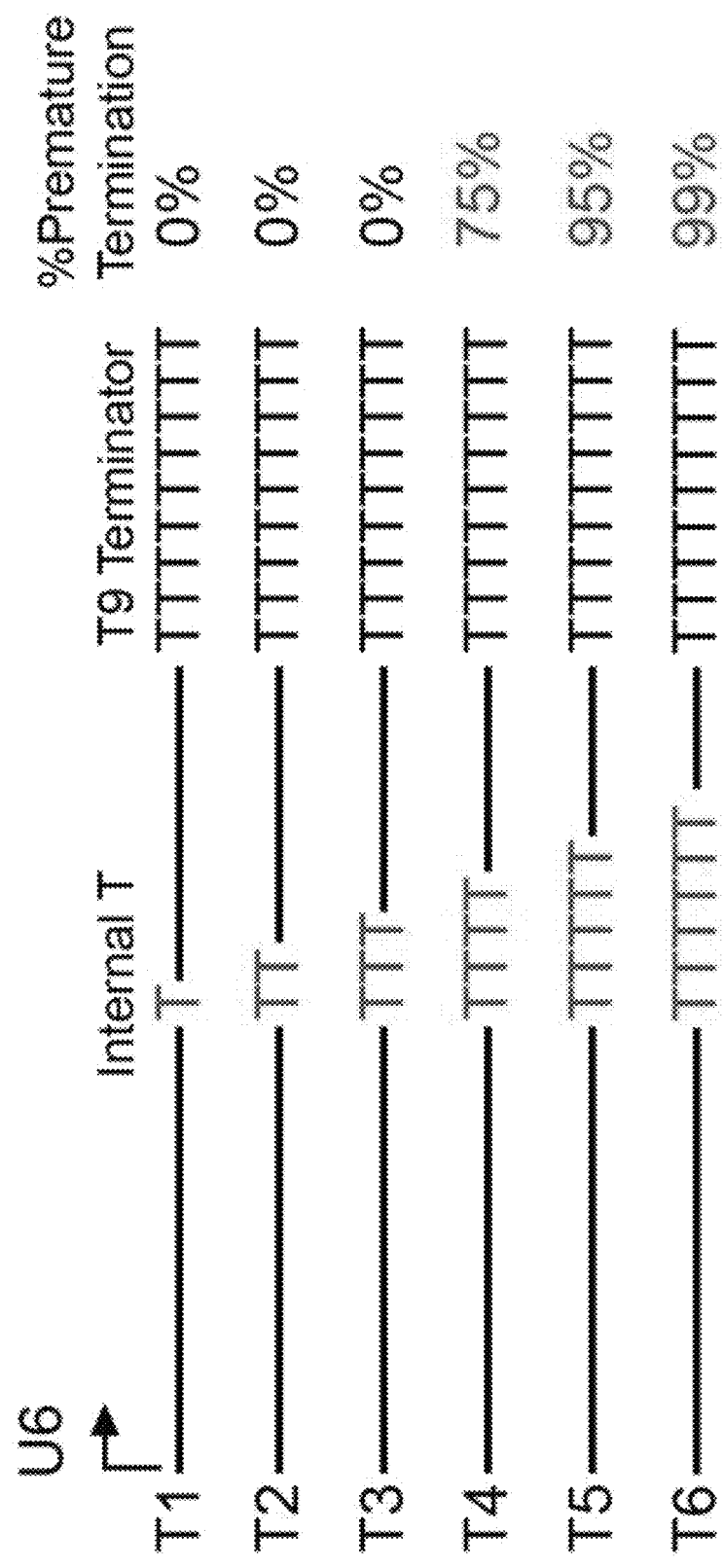
FIG. 9, comprising
Figures 9, 9F:
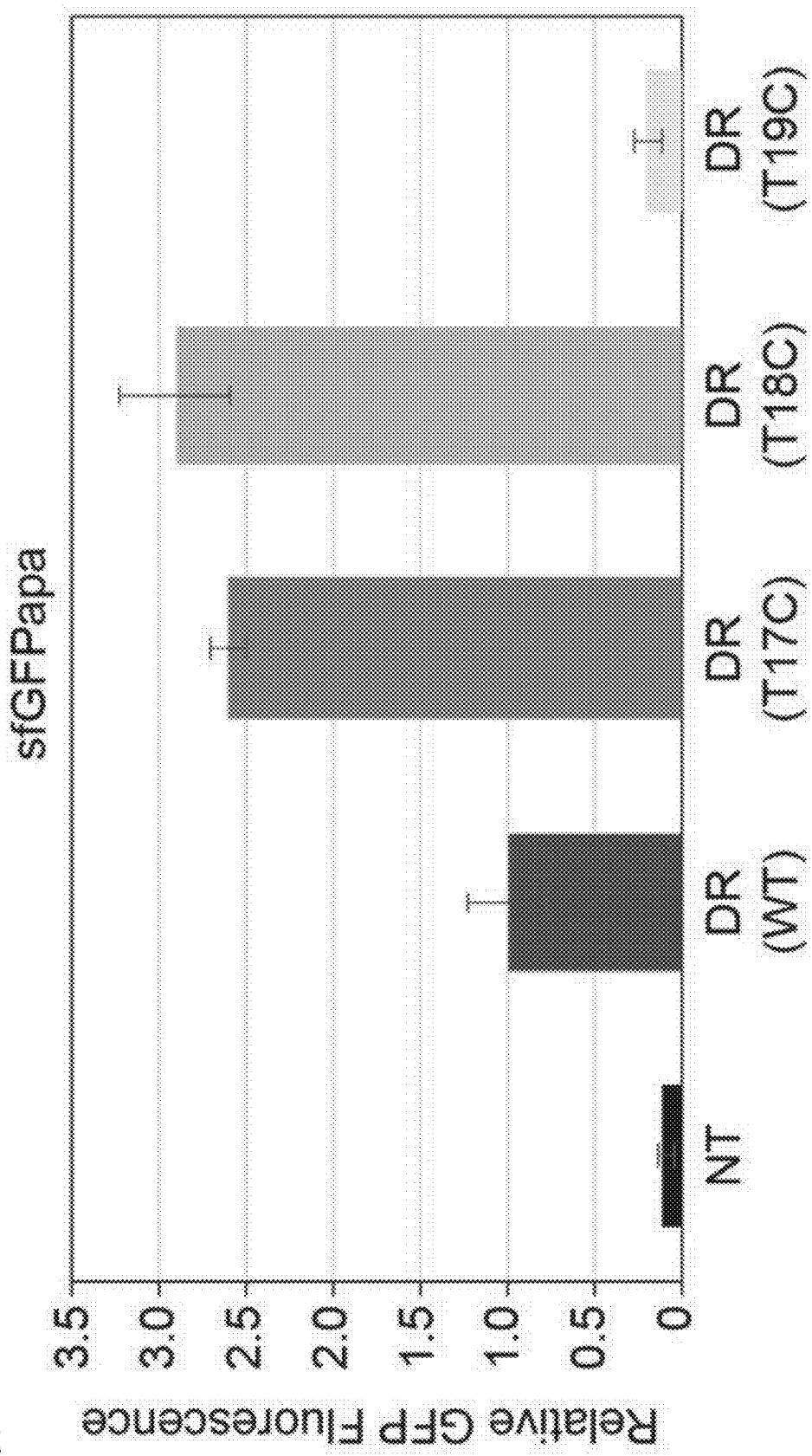
FIG. 9F depicts experimental results demonstrating the determination of their relative effectiveness in Postscriptr targeted activation of the sfGFPapa fluorescent reporter. Remarkably, two mutations T17C and T18C resulted in enhanced Postscriptr activity, whereas another mutation T19C resulted in decreased activity similar to a non-targeting (NT) guide-RNA.

Example 2: Disruption of Poly(T) Sequence in the Direct Repeat of PspCas13b crRNA Enhances Postscriptr Activity CRISPR-Cas13 systems are naturally guided by small CRISPR RNAs (crRNAs), which are typically expressed in mammalian cells by Polymerase III (Pol III) promoters, for example U6, 7SK or H1. Unlike Pol II dependent polymerases, Pol III promoters are terminated by short poly(T) sequences, often comprised of only 6 or more contiguous T's. Detailed analysis of the termination specificity of Pol III promoters, both in vitro and in mammalian cells, revealed that even short stretches of 4 T's leads to a 75% decrease in the full length expression of a small RNA (FIG. 9A) (Gao et al., Mol Ther Nucleic Acids, 2018, 10:36-44). Many Cas13b family members contain 4-5 internal T's within their Direct Repeat (DR) sequences, which could significantly prevent their efficient expression from Pol III driven promoters and inhibit Cas13b targeting (FIG. 9B). It is currently unclear whether these sequences, which fall within the loop region of the DR (FIG. 9C), are essential for Cas13b targeting. Recent high-resolution crystal structures for both PbuCas13b and BzoCas13b showed that at least one T coded for a U which was oriented away from the Cas13b protein, indicating these nucleotides at these positions may not be required for specific interactions (FIG. 9D). To determine if the poly(T) sequence in the PspCas13b DR could be disrupted to enhance crRNA expression, conservative (U to C, pyrimidine to pyrimidine) single mutations were generated to determine their effect on Postscriptr (dPspCas13b-NUDT21) targeted activation of the sfGFPapa fluorescent reporter (FIG. 9E). Remarkably, mutation of nucleotides at two sites, T17C or T18C, resulted in enhanced Postscriptr activity, whereas mutation of T19C abolished activity. These results indicate that enhanced activity may derive from increased crRNA yield, whereas mutation of some positions may inhibit normal Cas-crRNA binding.

Figure 11:
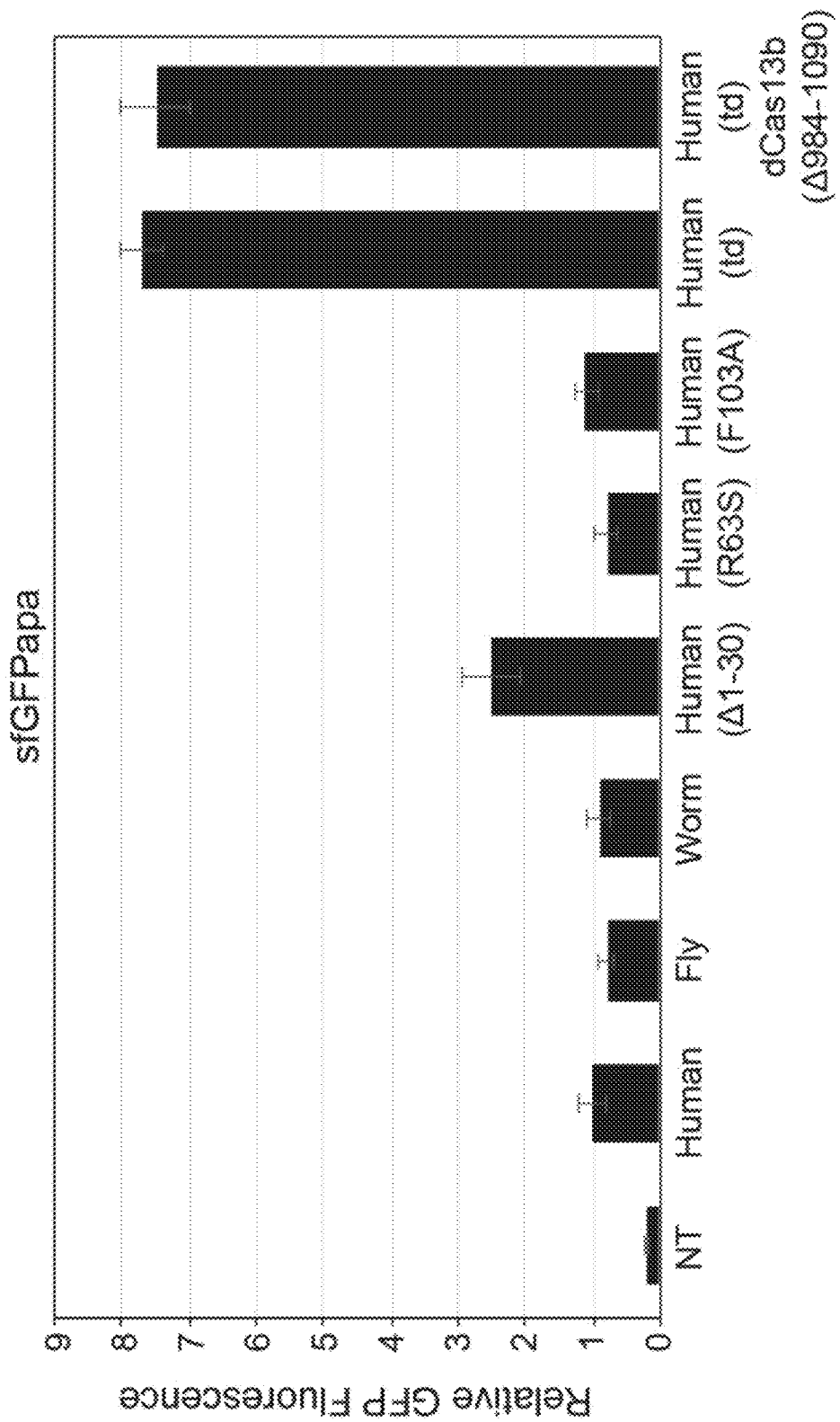
FIG. 11 depicts experimental results demonstrating the relative activities of Postscriptr fusion proteins. The impact of different sequence modifications to the dPspCas13b-NUDT21 fusion protein were assessed using activation of the sfGFPapa reporter in mammalian cells guided by an intronic targeting crRNA. Remarkably, fly and worm orthologs of NUDT21 showed comparable levels of activation relative to human, which is likely due to their high sequence conservation across species and conserved role in polyadenylation. These orthologs differ at their N-terminus, which is not only dispensable for Postscriptr-mediated activation, but resulted in enhanced activity. This may be due to the fact that acetylation of Lysines in these regions has been shown to inhibit NUDT21 activity. Mutation of residues which prevent RNA binding by NUDT21 (R63S and F103A) showed little effect on its function as a fusion to dCas13. Strikingly, a tandem dimer of NUDT21, which normally functions as an obligate dimer, resulted in markedly enhanced activation. Further, Postscriptr enzymes with a truncated C-terminus of dPspCas13 (4984-1090), showed similar levels of sfGFPapa activation.

Example 3: Modulation of the Postscriptr Fusion Protein and Impact on Targeted RNA Cleavage and Polyadenylation The NUDT21 polyadenylation factor is highly conserved across distance species. Multiple protein sequence alignment of NUDT21 orthologs from human, fly and worm revealed strong sequence identify across species (FIG. 10). Remarkably, in the context of the Postscriptr (dPspCas13b-NUDT21) fusion protein, NUDT21 orthologs from distance species showed similar activation of the sfGFPapa reporter in mammalian cells (FIG. 11).

While these orthologs share considerable sequence identity, they show little conservation within the first ~30 N-terminal amino acids (FIG. 10). This region may act as a negative regulatory region for human NUDT21, such that when residues in this region are acetylated, inhibit the interaction between poly(A) polymerase (PAP) and the CF1m complex (Shimazu et al., J Biol Chem, 2007, 282: 4470-78). Consistent with this role, deletion of the N-terminal 30 amino acids of human NUDT21 in the context of the Postscriptr fusion protein were dispensable for activity and rather resulted in enhanced activation of the sfGFPapa reporter.

While NUDT21 is normally targeted to RNA polyadenylation sequences through direct RNA binding, mutation of residues which abolish 99% of NUDT21 RNA binding (R63S or F103A) had little effect on Postscriptr activity, which is in the context of the Postscriptr fusion protein is targeted to RNA by dCas13 (Yang et al., PNAS, 2010, 107:10062-67; Yang et al., Structure, 2011, 19:368-77).

Since NUDT21 functions as an obligate dimer, a Postscriptr fusion protein encoding a forced tandem dimer of NUDT21 was generated, which strikingly, resulted in significant enhanced activation of the sfGFPapa reporter.

Consistent with previous reports showing that significant truncation of the C-terminus of dPspCas13b has little effect on RNA targeting (Cox et al., Science, 2017, 358:1019-27), a similar deletion in the context of the Postscriptr fusion protein had little effect on Postscriptr activity, but may be advantageous for reducing the total size of the fusion protein for viral delivery by AAV.

Example 4: Postscriptr-Cas13-Mediated Prevention of Myotonic Dystrophy

Myotonic Dystrophy (DM) is an autosomal dominant inherited genetic disease which is characterized by progressive muscle weakness, muscle loss, myotonia, cardiac arrhythmias and cognitive dysfunction. DM is the most common form of adult-onset muscular dystrophy and occurs in roughly 1 in 8,000 individuals. In some regions, DM can occur in 1 in 500 individuals.

Figure 12:
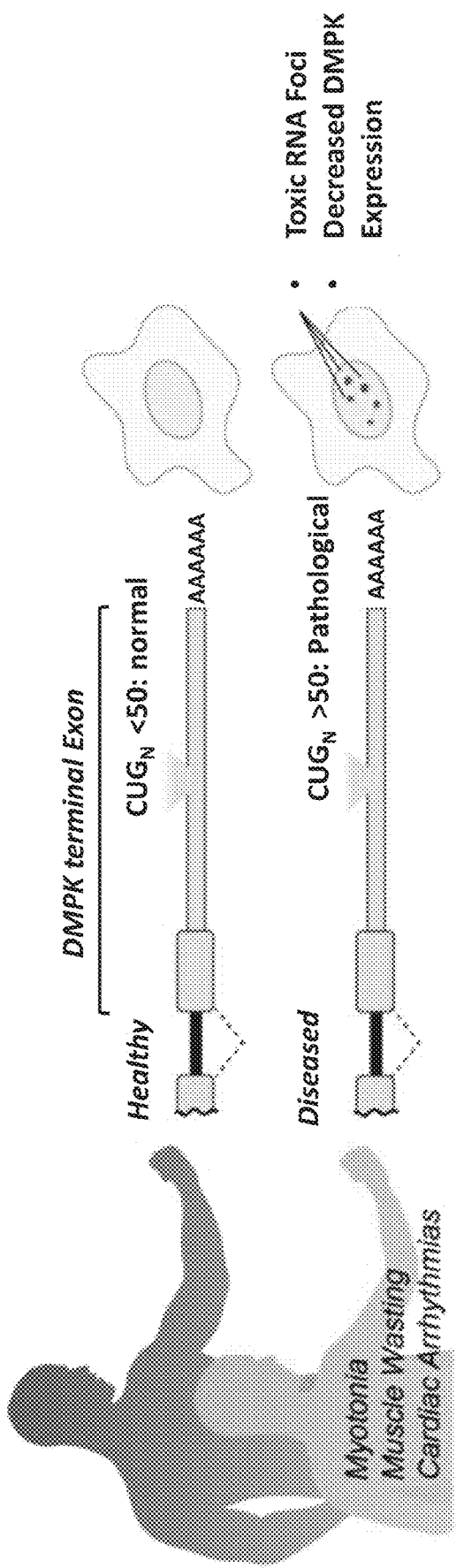
FIG. 12 depicts a schematic showing the molecular-genetic basis for Myotonic Dystrophy Type 1 (DM1). DM1 is a monogenic autosomal dominant disorder which is characterized by progressive muscle wasting, myotonia, cardiac arrhythmias, and cognitive dysfunction. DM1 is the most common adult-onset muscular dystrophy and arises from the expansion and expression of a CUG trinucleotide repeat in the noncoding 3' untranslated region of the human Dystrophia myotonica protein kinase (DMPK) gene. Mutant DMPK mRNAs with greater than ~50 CUG repeats form toxic nuclear RNA foci, which prevent normal DMPK expression and induce widespread defects in alternative splicing and alternative polyadenylation by sequestering members of the muscleblind-like (MBNL) family of RNA binding proteins. There are no approved therapies specific for DM1 and current strategies targeting CUG RNA repeats do not address loss of DMPK expression.

There are two types of DM, DM1 and DM2, which occur as a result of nucleotide repeat expansions in either the DMPK or CNBP genes, respectively. DM1 is more severe and more common and occurs as a result of a trinucleotide (CUG) repeat expansion in the non-coding, 3' untranslated region (3'UTR) of human DMPK gene on chromosome 19. Transcription of the DMPK RNA in individuals containing the CUG repeat expansion, larger than ~50 copies, results in the formation of toxic nuclear RNA foci, which bind and sequester the muscleblind-like (MBNL) family of RNA splicing factors (FIG. 12). This results in loss of MBNL function and widespread splicing abnormalities. While the coding sequence of DMPK is normal, formation of nuclear RNA foci by the abnormal DMPK transcripts also results in decreased DMPK expression.

There is currently no cure for DM. A current therapeutic approach is to use anti-sense oligonucleotides specific to the repeat expansion to prevent binding and sequestration of muscleblind-like proteins. Alternatively, knockdown of mutant DMPK transcripts could prevent accumulation of toxic repeat RNA, however, would result in loss of normal DMPK expression and function. Unfortunately, delivery and dosing of these oligonucleotide-based therapies remains a major challenge in human patients.

Postscriptr, as described in Example 1, allows for targeted RNA cleavage and polyadenylation of RNA transcripts by CRISPR-Cas13. The Postscriptr approach utilizes a fusion protein between catalytically inactive Cas13 (dPspCas13b) and the mammalian polyadenylation factor, NUDT21 (FIG. 13A). Targeting of the Postscriptr fusion protein using guide-RNAs is sufficient to induce RNA cleavage and polyadenylation (Example 1). Thus, Postscriptr-guided polyadenylation of DMPK transcripts would allow for both normal expression of DMPK coding sequences and prevent transcription of downstream toxic RNA repeat sequences (FIG. 13B). Postscriptr technology could be delivered using AAV, or other emerging viral delivery methods, for long term expression in somatic cells of DM1 individuals. Importantly, since Postscriptr technology only targets the DMPK RNA, there is no potential for "off-target" DNA genome editing or potential for germline transmission.

The terminal exon of the human DMPK transcript is 923 nucleotides long and contains both terminal coding sequences and the entire 3' UTR. Normal cleavage and polyadenylation occurs downstream of a conserved consensus PAS (AAUAAA (SEQ ID NO:789)) sequence. The CUG trinucleotide repeat expansion present in human DM1 patients occurs within the noncoding 3'UTR region of the terminal exon of human DMPK gene, ~200 nucleotides downstream of the stop codon (FIG. 12).

Since DMPK transcripts are expressed in human HEK293T cells, it was determined if Postscriptr could cleave and polyadenylate endogenous DMPK transcripts in this human cell line. crRNAs were designed targeting the terminal exon of human DMPK, upstream of the CUG repeat expansion site. The Postscriptr fusion protein and crRNAs were co-expressed into HEK293T cells for 24 hours, after which total RNA was isolated for subsequent analysis by 3' Rapid Amplification of cDNA Ends (RACE) using a custom poly (T) oligonucleotide. PCR-based amplification using two nested DMPK-specific primers showed that one crRNA in particular induced the expression of a polyadenylated transcript shorter than the full length 3'UTR (DMPK-PS) (FIG. 13C). Sequencing of this band revealed that it was specific to the DMPK 3'UTR and that cleavage and polyadenylation occurred 70 nucleotides downstream of the crRNA target sequence (FIG. 13D). This corresponds to ~130 nucleotides upstream of the site of CUG repeat expansion. Interestingly, a band corresponding to the full length DMPK exon (DMPK-FL) was reduced in Postscriptr modified cells (FIG. 13D). Despite the presence of a conserved PAS sequence in this region, a few human DMPK mRNAs have been reported with a similar proximal cleavage and polyadenylation site. These data demonstrate the Postscriptr is sufficient to direct premature targeted cleavage and polyadenylation of human DMPK transcripts, which may be aided by endogenous cryptic upstream or downstream polyadenylation sequence elements. Since Postscriptr editing results in premature termination of DMPK transcripts, this approach may be therapeutically useful for the treatment of DM1.

Example 5: Targeted Alternative Cleavage and Polyadenylation of Human DMPK Transcripts Myotonic Dystrophy Type 1 (DM1) is a monogenic autosomal dominant disorder which is characterized by progressive muscle wasting, myotonia, cardiac arrhythmias, and cognitive dysfunction. DM1 is the most common adult-onset muscular dystrophy and arises from the expansion and expression of a CUG trinucleotide repeat in the noncoding 3' untranslated region of the human Dystrophia myotonica protein kinase (DMPK) gene. Mutant DMPK mRNAs with greater than ~50 CUG repeats form toxic nuclear RNA foci, which prevent normal DMPK expression and induce widespread defects in alternative splicing and alternative polyadenylation by sequestering members of the muscleblind-like (MBNL) family of RNA binding proteins. There are no approved therapies specific for DM1 and current strategies targeting CUG RNA repeats do not address loss of DMPK expression.

Alternative polyadenylation (APA) of RNA is an important regulatory mechanism controlling gene expression during development and disease. Recent deep sequencing has revealed that some DMPK transcripts can be alternatively cleaved and polyadenylated at a position upstream of the site of CUG expansion, suggesting that manipulating APA could be a useful approach for both preserving DMPK expression while preventing transcription of downstream toxic repeat RNAs. Examples 1 and 2 demonstrate a novel RNA-editing technology, named Postscriptr, which combines the programmable RNA-targeting capability of CRISPR-Cas13 with a mammalian polyadenylation factor to induce site-specific cleavage and polyadenylation of RNA transcripts. The data presented herein demonstrates Postscriptr can robustly induce alternative cleavage and polyadenylation of endogenous human DMPK transcripts upstream of the site of CUG repeat expansion. Thus, as discussed herein, targeted alternative polyadenylation of mutant DMPK transcripts by Postscriptr both rescues DMPK expression and prevents the transcription of downstream toxic CUG repeat RNA.

Molecular Origins of DM1

DM1 is among a class of human monogenic autosomal dominant disorders that, at a molecular level, arises from an excessive expansion of a trinucleotide CTG repeat in the 3'-untranslated region of the DM protein kinase (DMPK) gene on human chromosome 19 (FIG. 14A) (Fu et al., Science, 1992, 255:1256-58; Mahadevan et al., Science, 1992, 255:1253-55). CTG repeat length is positively correlated with age of onset and disease severity, with 5-35 repeats observed in unaffected individuals, at least 50 repeats in mild DM1 patients, and thousands of repeats possible in severe, congenital DM1 patients (Brook et al., cell, 1992, 68:799-808; Martorell et al., Neurology, 2001, 56:328-35; Harley et al., Am J Hum Genet, 1993, 52:1164-74). Transcribed DMPK mRNA with more than 5 CUG repeats is thought to form a hairpin structure that increases in stability as repeat length increases (FIG. 14B) (Napierala & Krzyzosiak, J Biol Chem, 1997, 272:31079-85; Tian et al., RNA, 2000, 6:79-87). The abnormal hairpin structure of $CUG^{exp}$ RNA is tightly bound by several proteins, notably the muscleblind-like (MBNL) family of RNA regulatory proteins, which become sequestered in nuclear foci (FIG. 14B and FIG. 14C) (Mankodi et al., Hum MO1 Genet, 2001, 10:2165-70; Tanej a et l., J Cell Biol, 1995, 128:995-1002). Functional loss of MBNL proteins cause widespread defects in RNA processing, including defects in alternative splicing and polyadenylation of several important muscle genes (Nakamori et al., Ann Neruol, 2013, 74:862-72; Kuyumcu-Martinez & Cooper, Prog MO1 Subcell Biol, 2006, 44:133-59; Batra et al., Mol Cell, 2014, 56:311-22). Defects in alternative splicing in >100 genes are thought to contribute to the severity of symptoms in DM1 patients and drive muscle weakness and wasting, which include important muscle ion handling proteins such as the voltage-regulated chloride channel (ClC-1), ryanodine receptor type 1 (RyR1), beta subunits of voltage-gated L-type $Ca^{2+}$ channel (Cav1.1)

and sarcoplasmic/endoplasmic Ca$^{2+}$-ATPase 1 (SERCA1). Alternative splicing of ClC-1, the major chloride channel expressed in skeletal muscle, leads to decreased ClC-1 expression and is the origin of myotonia in DM1 patients (Wheeler et al., J Clin Invest, 2007, 117:3952-57). An animal model of DM1 is created by overexpressing CUG$^{exp}$ RNA in skeletal muscle which shares many of the splicing and polyadenylation defects found in patients with DM1 (Mankodi et al., Science, 2000, 289:1769-73). Thus, DM1 arises from the expression of toxic RNA and led to the discovery that DM1 pathogenesis was primarily due to the loss of function of MBNL family members (MBNL1 and 2). Mice lacking MBNL1 and 2 account for up to 80% of the observed DM1 phenotype, recapitulating some of the cardiovascular, muscle, eye, and RNA-splicing abnormalities found in human patients (Kanadia et al., Science, 2003, 302:1978-90; Lee et al., EMBO Mol Med, 2013, 5:1887-900). However, overexpression of MBNL proteins in DM1 mouse models have had limited success rescuing splicing and modest amelioration of muscle symptoms in mouse models of DM1, suggesting a multifactorial cause for DM1 symptoms (Yadava et al., Hum Geet, 2019; Kanadia et al., PNAS, 2006, 103:11748-53). Indeed, in addition to the observed RNA toxicity, CUG$^{exp}$ RNA has been reported to give rise to aberrant repeat-associated non-ATG translation (RAN) and accumulation of toxic polyL, polyC, and polyA peptides (Zu et al., PNAS, 2011, 108:260-65). Given the multitude of dysfunctional pathways associated with pathogenic expanded CUG repeat RNA, the most beneficial treatments should aim to prevent the expression of CUG$^{exp}$ RNA repeats from the mutant DMPK locus, while simultaneously preserving DMPK expression.

Current Challenges for Treating DM1 in Humans

Despite intense effort, treatment options for DM1 are limited, in part due to the complexity of DM1 pathogenesis, i.e. expression of toxic gain-of-function microsatellite repeat RNA (Thornton et al., Curr Opin gen & Devel, 2018, 44:135-40). One promising strategy for treating DM1 is the use DMPK-targeting antisense oligonucleotides (ASOs) to reduce the levels of toxic RNAs or prevent binding and sequestering of MBNL family proteins (Jauvin et al., Mol Ther Nucleic Acids, 2017, 7:465-74; Wheeler et al., Nature, 2012, 488:111-15). However, significant challenges remain for efficient delivery of ASOs to reach therapeutically effective levels in skeletal muscle in human patients (clinicaltrials.gov identifier: NCT02312011). Microsatellite repeat RNAs are resistant to RNA induced degradation, likely due to their stable hairpin structure, providing many challenges for this approach. Additionally, off-target ASO knockdown of other human mRNA transcripts which contain short CUG-repeat motifs in their coding sequence, such as calcium/calmodulin dependent serine protein kinase (CASK), mitogen-activated protein kinase kinase kinase 4 (MAP3K4) or LDL receptor related protein 8 (LRP8), could have potentially deleterious effects in DM1 patients.

Genome editing approaches using bacterial derived CRISPR-Cas endonucleases are among the latest strategies aimed at correcting DM1. CRISPR-Cas9 editing strategies have been employed to directly edit the DMPK gene locus. While single cut CRISPR-Cas9 editing at either the 5' or 3' ends of the CTG genomic repeats can induce large and uncontrolled sequence deletions, use of double guide-RNAs flanking the repeat expansion have allowed for precise deletion of repeat sequences (van Agmall et al., Mol Ther, 2018, 25:24-43; Wang et al., Mol Ther, 2018, 26:2617-30). However, this can lead to frequent sequence inversions (~7%), which themselves can be toxic. Interestingly, genome editing of the DMPK locus using CRISPR-Cas9 to insert a polyadenylation cassette upstream of the CTG expansion has been shown to prevent downstream expression of CUG$^{exp}$ RNA, thereby inhibiting RNA foci formation and RNA-induced cytotoxicity in DM1 patient derived iPS cells (Gao et al., Mol Ther, 2016, 24:1378-87. However, the ability to deliver templated polyadenylation sequences using CRISPR-Cas in vivo remains challenging, given the low efficiency for homology directed repair (HDR) in non-dividing tissues. In addition, while these strategies have shown promising results in cell and DM1 animal models, editing human genomic DNA remains controversial due to the potential for germline editing. Alternatively, fusion of a ribonuclease domain to catalytically inactive Cas9 (dCas9), which can recognize both DNA and RNA, has allowed degradation of microsatellite repeat RNA by directly targeting the CUG-repeat sequence (Batra et al., 2017, Cell, 2018, 170:899-912). However, similar to the off-target potential of repeat-targeted ASOs, this approach has the potential to cleave other, non-pathogenic human mRNAs containing CUG-repeat motifs. Thus, significant challenges remain in the development of therapeutic strategies to target toxic RNAs in DM1 patients.

Targeted Cleavage and Polyadenylation of RNA by CRISPR-Cas13

Until recently, direct manipulation of mRNA alternative cleavage and polyadenylation has been limited to genome-editing approaches such as insertion of a polyadenylation cassette into the DNA, which is technically challenging and not therapeutically efficient. Examples 1 and 2 demonstrate the development of a novel RNA-editing technology, called Postscript", that allows for site-specific cleavage and polyadenylation of RNA in mammalian cells by fusing catalytically dead Cas13 (dCas13) with NUDT21, a master regulator of mammalian polyadenylation. Postscriptr technology allows for direct targeting of mRNAs for both cleavage and polyadenylation, which can be induced at any sequence along an mRNA or at an endogenous alternative polyadenylation site. Unlike other CRISPR tools that directly edit the genome, Postscriptr can be used for therapeutic applications to alter gene expression post-transcriptionally, to treat human RNA processing diseases without manipulating the patient's DNA.

Here, Postscriptr RNA-editing is used to target human mutant DMPK transcripts and determine the effectiveness of this approach for treating DM1 symptoms, including histological (muscle wasting and weakness), cellular (centralized nuclei, fiber type change) and molecular (RNA foci formation, MBNL1 mis-localization, and alternative splicing defects). This framework allows for a determination of the efficacy of Postscriptr-targeted alternative polyadenylation of DMPK transcripts as a potential therapy for DM1 in human patients. Packaging of Postscriptr editing components into non-integrating viral gene delivery particles, such as AAV, which are currently being tested in gene therapy trials for a number of skeletal muscle dystrophies, provide a robust delivery approach in human patients. Importantly, the design, development, testing, and delivery of reagents targeting human DMPK transcript sequences allows for the rapid translation of this approach for potential future clinical applications of Postscriptr to prevent DM1 in human patients.

Mammalian 3' End Processing

Figure 15:
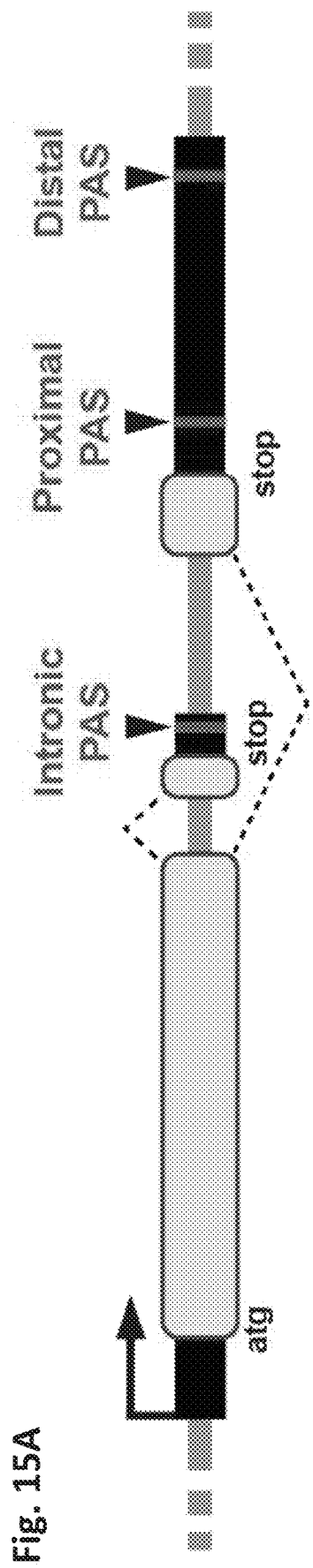
FIG. 15, comprising
Figures 15, 15B:
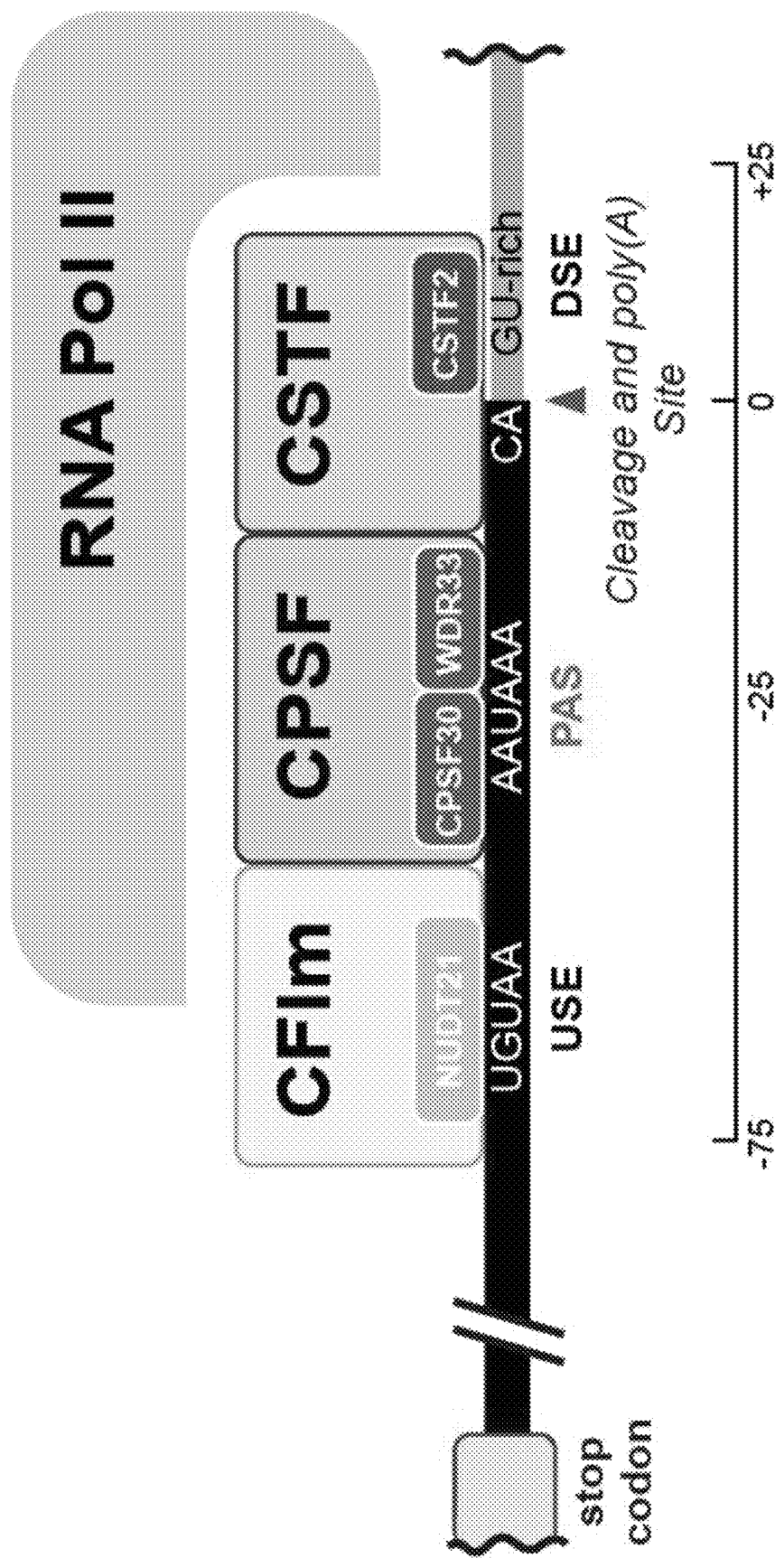
Figures 15, 15C:
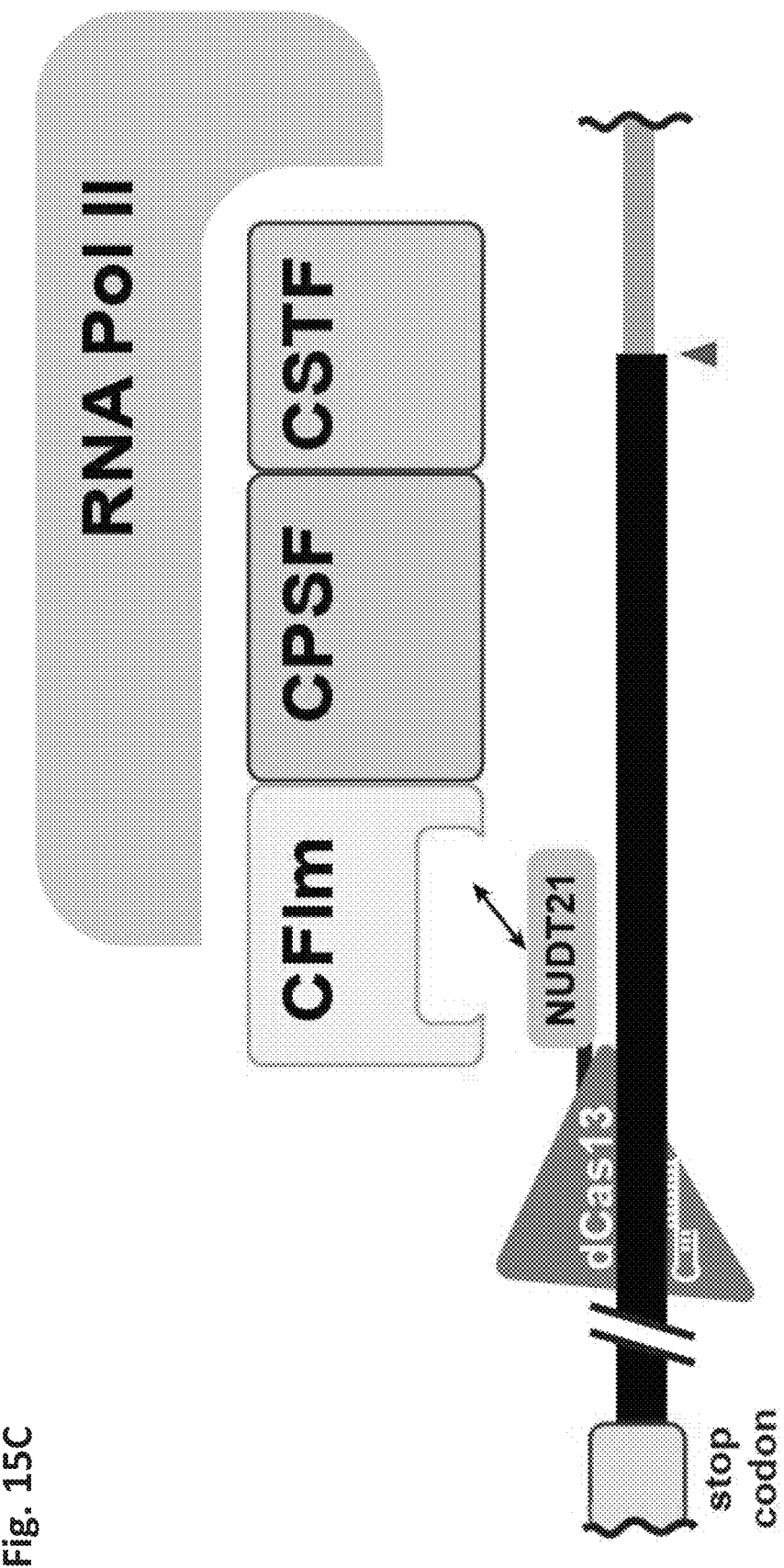

More than half of all human genes undergo alternative cleavage and polyadenylation, including DMPK. (FIG. 15A). Polyadenylation plays an essential role in controlling RNA transcript stability, nuclear export, and translation efficiency. The 3' site of RNA cleavage and addition of a poly(A) tail is determined by intrinsic polyadenylation signal (PAS) sequences typically composed of a canonical hexamer motif AAUAAA (SEQ ID NO:789) and upstream and downstream sequence elements (FIG. 15B). The AAUAAA PAS motif is found ~25 nucleotides (nts) upstream of the RNA cleavage site and is directly bound by two components of the cleavage and polyadenylation specific factor (CPSF) complex: cleavage and polyadenylation factor 30 (CPSF30) and WD repeat-containing protein 33 (WDR33). Components of the cleavage factor Im (CFIm) complex bind directly to the USE motif UGUA which occurs ~50 nts upstream of the RNA cleavage site. In transcripts that lack the canonical AAUAAA (SEQ ID NO:789) motif, the CFIm complex functions as the primary determinant of poly(A) signal recognition. Nudix Hydrolase 21 (NUDT21), the RNA-binding component of the CFIm complex, functions as an activator of 3' end processing and regulator of alternative polyadenylation site choice. CFIm complex binding is among the first steps in 3' end processing and it recruits additional co-factors to the 3' end processing machinery. Direct interactions between polyadenylation supercomplex components and the C-terminal domain of RNA polymerase II trigger the disassembly of the elongation complex and coordinate 3' end processing with transcription termination. While the endogenous cellular mechanisms regulating APA site choice remain unclear, the ability to direct RNA cleavage and polyadenylation would allow for precise control over alternative gene isoform expression and transcript termination. The data presented herein demonstrates the development of a programmable RNA editing technology to direct mammalian 3' end processing using CRISPR-Cas13 (FIG. 15C).

RNA Targeting and Manipulation by CRISPR-Cas13

Bacterial-derived Type VI CRISPR-Cas systems encode a family of RNA-guided endoribonucleases, named Cas13 (Abudayyeh et al., Science, 2016, 353:aaf5573; Smargon et al., MOl Cell, 2017, 64:618-30; East-Seletsky et al., Mol Cell, 2017, 66:373-83). Similar to Cas9, mutation of residues within the nuclease domains of Cas13 generate a catalytically dead enzyme that retains RNA binding ability (dCas13) (Cox et al., Science, 2017, 358:1019-27). To direct polyadenylation complex formation using dCas13, three fusion proteins were designed by combining the catalytically dead Type VI-B Cas13 enzyme from *Prevotella* sp. P5-125 (dPspCas13b) with RNA binding components of the human 3' end processing machinery, including CPSF30, WDR33, and NUDT21 (FIG. 16A). An N-terminal 3×FLAG epitope tag was included for protein detection and a long flexible peptide linker [GGGGSGGGGS (SEQ ID NO:69)] was included between dPspCas13b and the polyadenylation components to reduce the likelihood of steric hindrance.

Yeast Ty1 NLS Allows Efficient Nuclear Localization of dCas13 Proteins

Figure 17B:
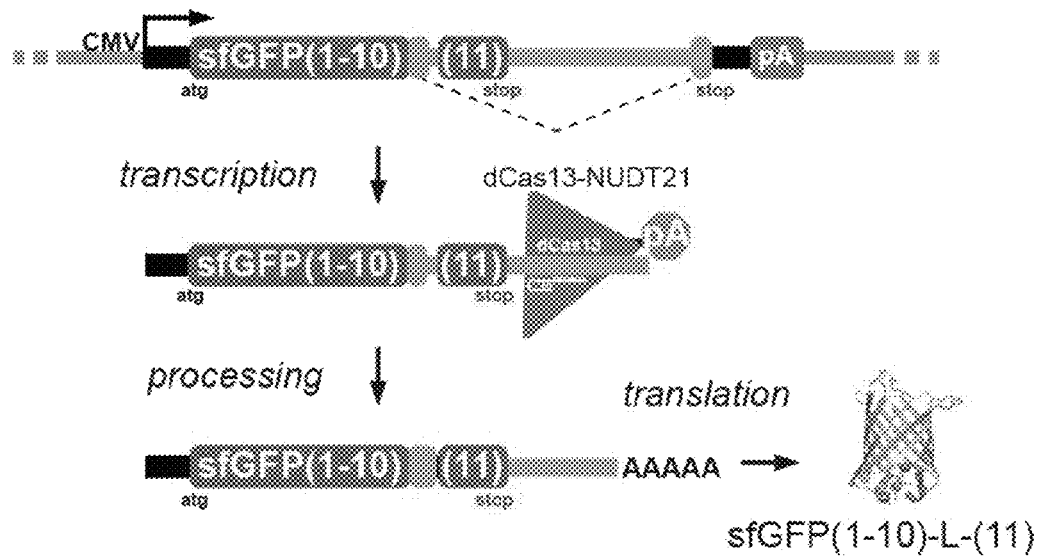
Figure 17:
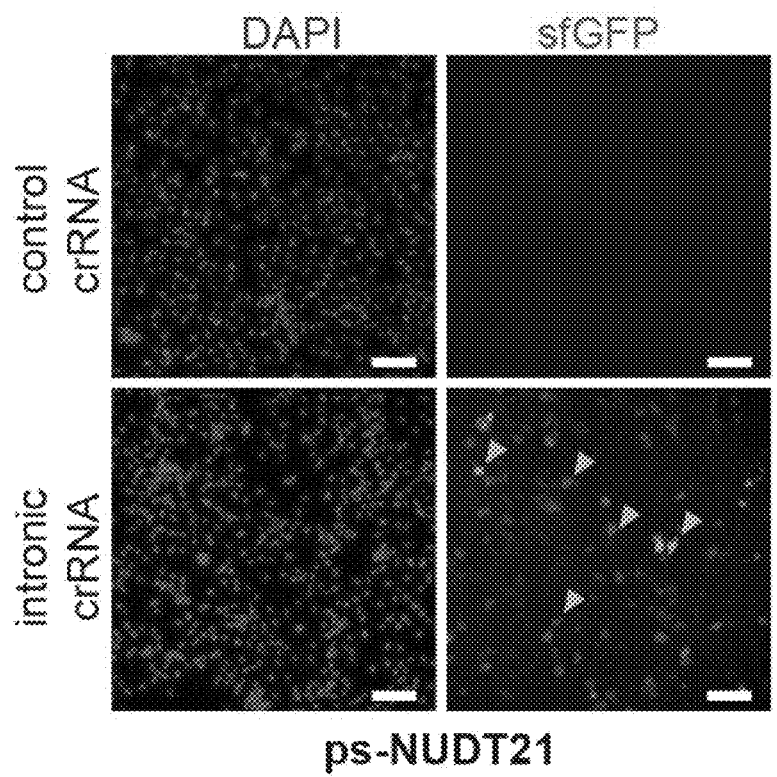
FIG. 17, comprising

While previous dCas13-mediated RNA editing applications occurred within the cytosol, post-transcriptional cleavage and polyadenylation of RNA occurs within the nucleus and therefore requires efficient nuclear localization of dCas13 fusion proteins. dCas13 proteins were unable to localize to the nucleus, likely due to their large size and lack of intrinsic nuclear localization signals (NLSs). Surprisingly, the addition of a classical SV40 NLS or bipartite NLS from nucleoplasmin (NPM) did not promote efficient nuclear localization of dPspCas13b fusion proteins. However, the addition of a single copy of the non-classical bipartite NLS derived from the yeast Ty1 retrotransposon, which utilizes normal cellular protein import machinery but contains a linker sequence nearly three times as long as a typical bipartite NLS (McLane et al., NAR, 2008, 36:4317-26; Kenna et al., Mol cell Biol, 1998, 18:1115-24), resulted in robust nuclear localization of dPspCas13b fusion proteins (FIG. 16B).

dPspCas13b-NUDT21 is Sufficient to Induce Targeted Cleavage and Polyadenylation of RNA To quantify and visualize cleavage and polyadenylation, a reporter capable of switching between fluorescent and non-fluorescent open reading frames (ORFs) of the superfolder GFP (sfGFP) was designed. A sfGFP reporter construct was generated with the coding sequence for the $11^{th}$ beta strand embedded within a prototypical mammalian intron (sfGFPapa) (FIG. 17A). Expression of the sfGFPapa reporter in mammalian COST cells resulted in almost no detectable fluorescence, suggesting efficient removal of the intron containing the $11^{th}$ beta strand and translation of the ORF encoding the non-fluorescent sfGFP protein. To determine whether the dPspCas13b fusion proteins could promote CRISPR-Cas13-mediated cleavage and polyadenylation of sfGFPapa reporter mRNA, a crRNA targeting an intronic sequence downstream of the coding sequence of the 11th beta strand of sfGFP in the sfGFPapa reporter was designed. In live cell assays, no fluorescence signal was detected in cells expressing any of the dPspCas13b fusion proteins using a non-targeting crRNA, relative to the sfGFPapa reporter alone. However, expression of the intron targeting crRNA with the dPspCas13b-NUDT21 fusion protein, but not the CPSF30 or WDR33 fusions proteins, resulted in detectable green fluorescent cells after 24 hours (FIG. 17B). 3' rapid amplification of cDNA ends (RACE) confirmed that sGFPapa mRNAs were cleaved and polyadenylated, at sites ranging from −7 to +110 nts relative to the 3' side of the crRNA target sequence. Because dPspCas13b-NUDT21 was efficient to polyadenylate mRNA, this targeting approach was named Postscriptr. In contrast to mammalian cleavage which occurs primarily after a CA dinucleotide, Postscriptr-induced cleavage most often occurred at a C or T nucleotide. These data demonstrated that the dPspCas13b-NUDT21 fusion protein was sufficient to induce cleavage and polyadenylation of a reporter mRNA at an intronic sequence targeted by a crRNA.

Targeting Endogenous Human DMPK Transcripts in Cells

Figure 18:
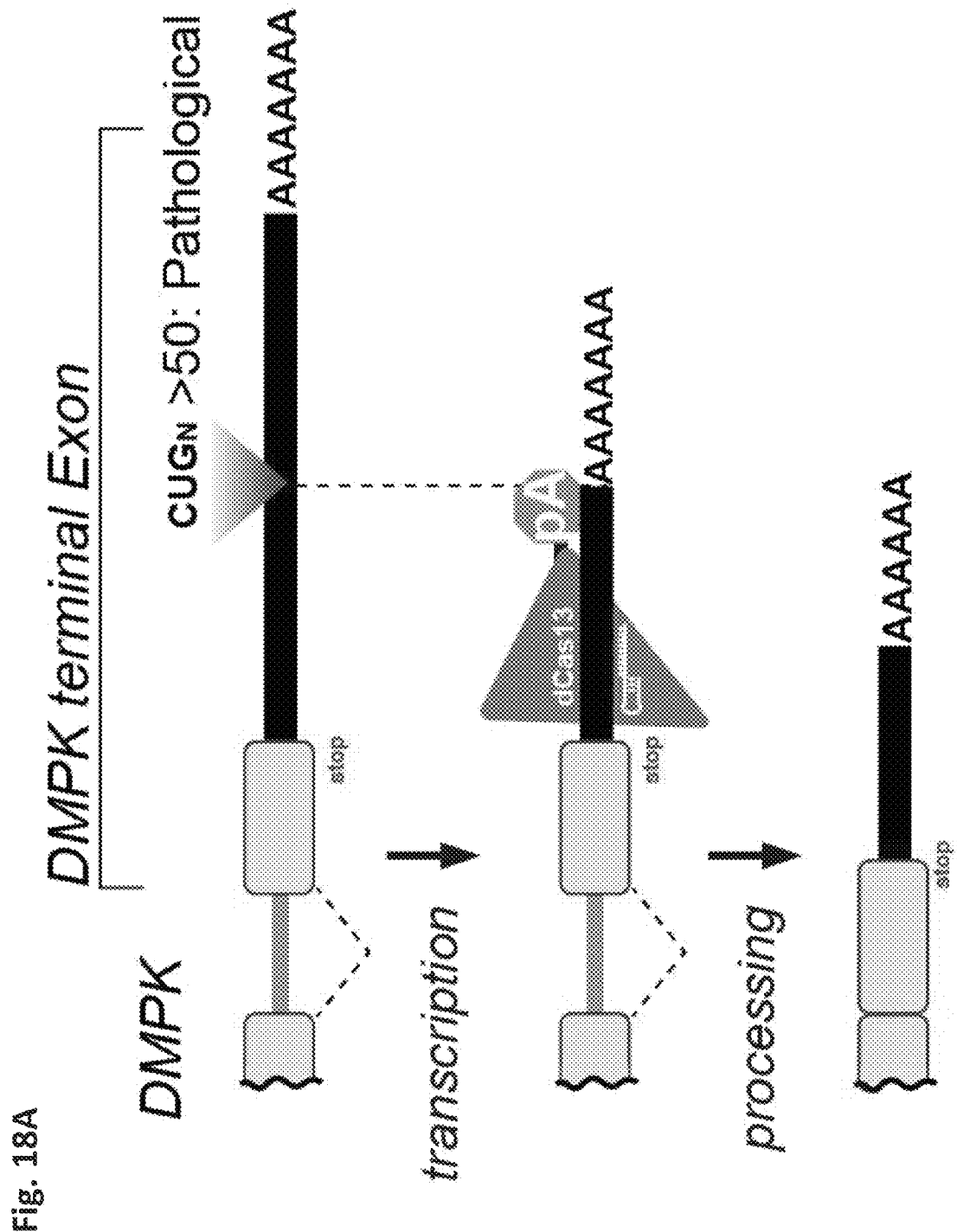
FIG. 18, comprising
Figures 18, 18B:
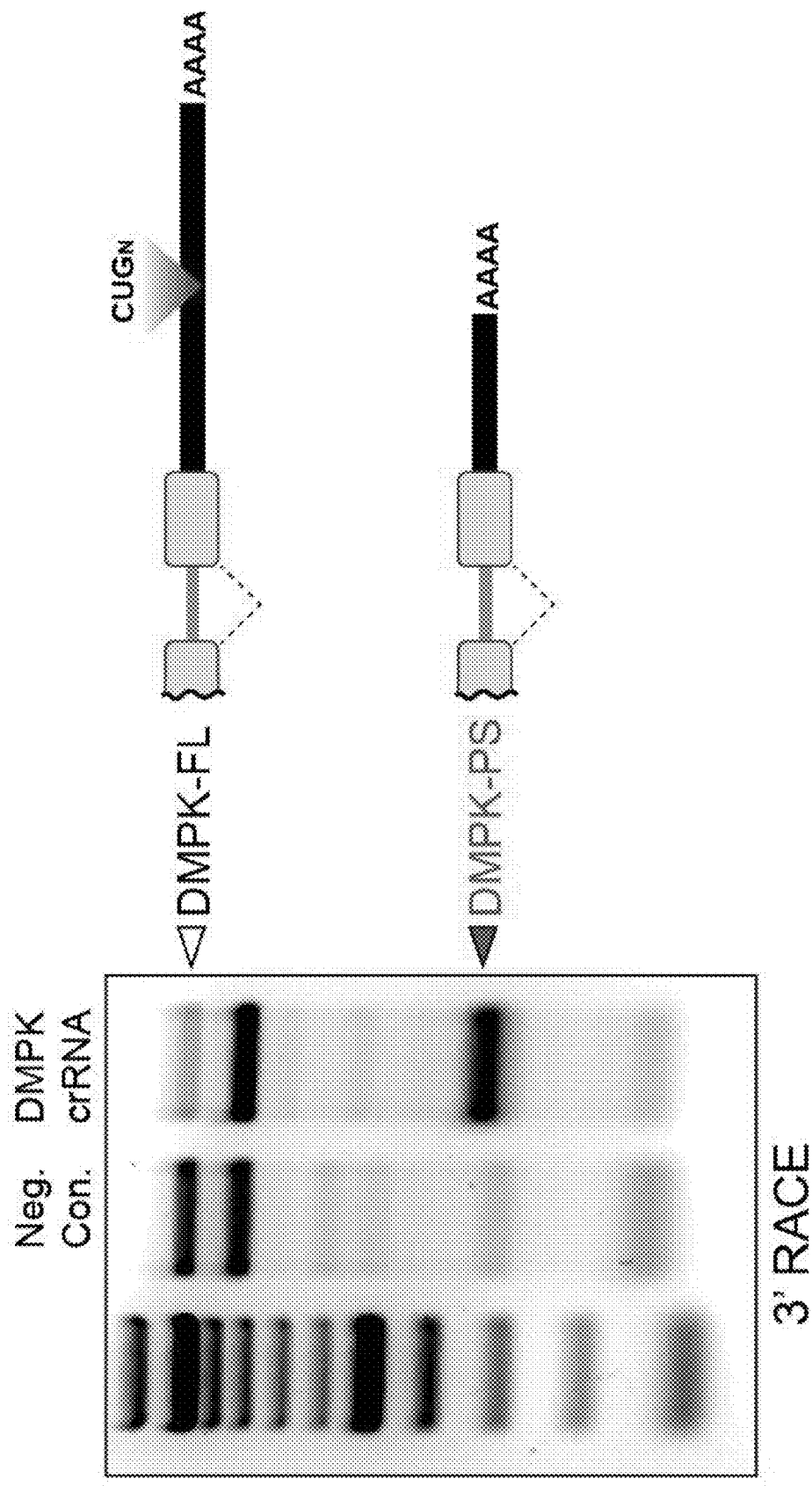

The presence of multiple alternatively spliced DMPK transcripts and potential alternative polyadenylation signal sequences suggests the mechanisms controlling DMPK function are complex and may vary across and within tissues. The major long isoform of DMPK encodes a C-terminal single transmembrane alpha helix, which localizes DMPK protein to intracellular membranes, likely supporting its role phosphorylating membrane bound targets, such as Phospholamban or Myoregulin. A shorter isoform of DMPK lacks this C-terminal transmembrane helix, and is also predicted to be alternatively polyadenylated resulting in a truncated 3' UTR sequence. The terminal exon of the human DMPK transcript is 923 nucleotides long and contains both terminal coding sequences and the entire 3' UTR. Cleavage and polyadenylation occurs downstream of a conserved consensus PAS (AAUAAA (SEQ ID NO:789)) sequence. The CUG trinucleotide repeat expansion present in human DM1 patients occurs within the noncoding 3'UTR region of the terminal exon of human DMPK gene, ~200 nucleotides downstream of the stop codon (FIG. 18). Since DMPK transcripts are expressed in human HEK293T cells, it was determined whether Postscriptr could cleave and polyadenylate endogenous DMPK transcripts in this human cell line. crRNAs were designed targeting the terminal exon of human DMPK, upstream of the CUG repeat expansion site. The Postscriptr fusion protein and crRNAs were co-expressed into HEK293T cells for 24 hours, after which total RNA was isolated for subsequent analysis by 3' RACE using a custom poly (T) oligonucleotide. PCR-based amplification using two nested DMPK-specific primers showed that one crRNA in particular induced the expression of a polyadenylated transcript shorter than the full length 3'UTR (DMPK-PS) (FIG. 18). Sequencing of this band revealed that it was specific to the DMPK 3'UTR and that cleavage and polyadenylation occurred 70 nucleotides downstream of the crRNA target sequence (FIG. 18). Polyadenylation occurred ~130 nucleotides upstream of the CUG repeat expansion, corresponding to the normal cleavage and polyadenylation site of the alternatively spliced DMPK isoform. Importantly, in this case, expression of the full-length protein coding sequence was preserved. Additionally, a band corresponding to the full length DMPK transcript (DMPK-FL) was reduced in Postscriptr modified cells, demonstrating that the ratio of short to full-length DMPK isoforms were switched (FIG. 18). These data establish that Postscriptr is sufficient to direct premature targeted cleavage and polyadenylation of human DMPK transcripts which may be guided by endogenous upstream or downstream polyadenylation sequence elements. Since Postscriptr editing results in premature termination of DMPK transcripts upstream of $CUG^{exp}$, this approach could be therapeutically useful for the prevention of DM1.

$CUG^{exp}$ RNA in Nuclear Foci can be Targeted with dCas13

Figure 19:
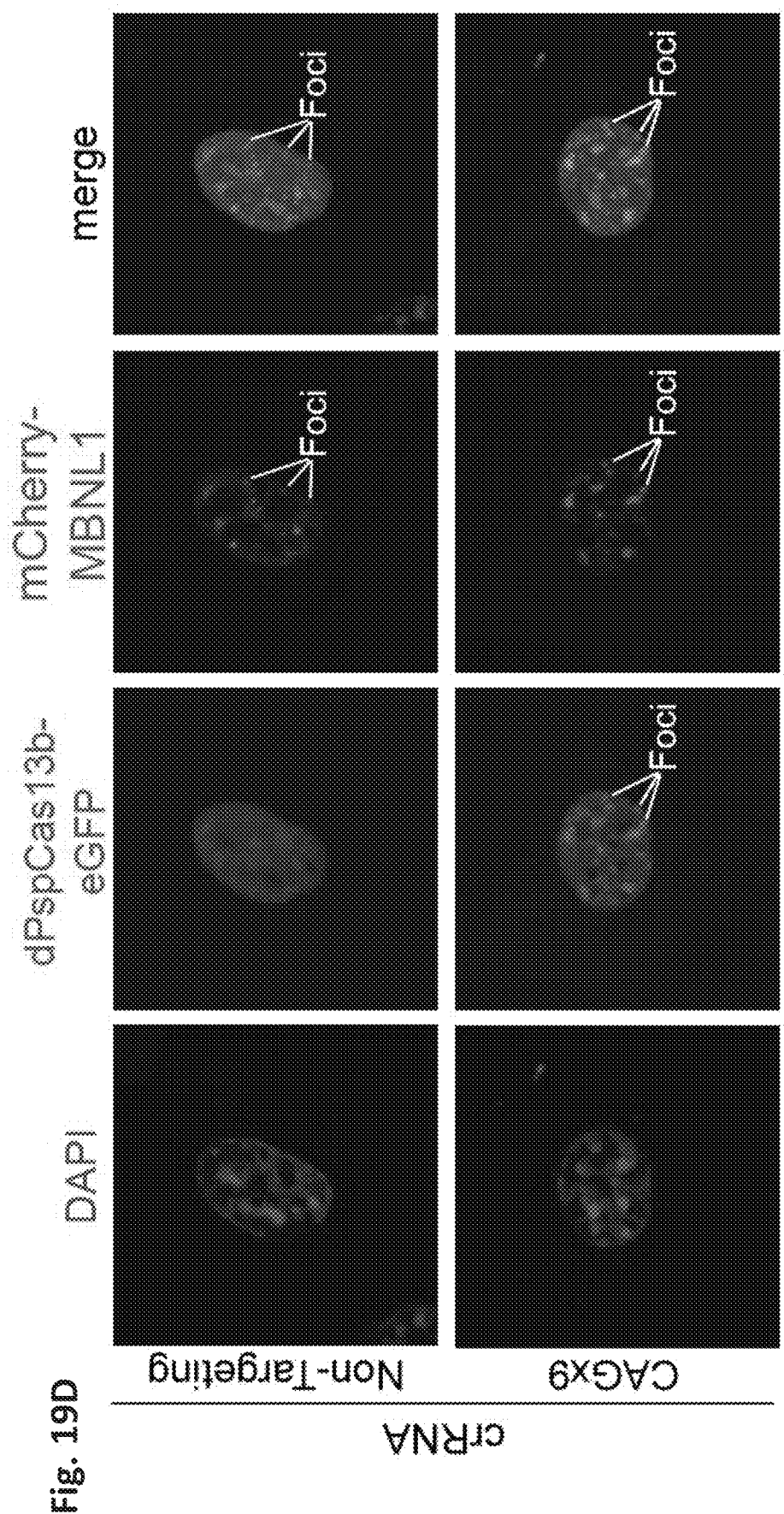
FIG. 19, comprising

As demonstrated in Examples 1-4, Postscriptr can induce cleavage and polyadenylation of DMPK transcripts to prevent expression of full-length DMPK, which in the case of mutant DMPK mRNAs, would encode toxic CUG repeats. Since DM1 patients have a large pre-existing fraction of mutant DMPK RNAs present in nuclear RNA foci, it may be beneficial to target this pool of mutant mRNA transcripts in addition to preventing their formation with Postscriptr. To determine whether dCas13 can be efficiently targeted to nuclear RNA foci, a fluorescent fusion protein was designed combining dPspCas13b with enhanced Green Fluorescent Protein (eGFP) (FIG. 19). The Ty1 nuclear localization sequence (Ty1 NLS) was included on the N-terminus of the dPspCas13b-eGFP fusion protein to allow for robust nuclear localization (FIG. 19). As expected, when the dPspCas13b-GFP fusion protein was expressed in mammalian COST cells, GFP expression was restricted to the nucleus. To mimic the nuclear RNA foci found in patients with DM1, transient expression of a vector containing 960 CUG repeats in the context of the human DMPK locus including exons 11-15 was used (DT960, Addgene plasmid #80412) (FIG. 19B). To localize the dPspCas13b-eGFP fusion protein to CUG repeat sequences, a compatible crRNA was designed containing a CUG antisense repeat target sequence, which is predicted to hybridize with 9 CUG repeats (CAGx9 crRNA) (FIG. 19C). When co-transfected with the CUG-targeting crRNA, the dPspCas13b-eGFP fusion protein was robustly targeted to nuclear RNA foci generated by the expression of the mutant DMPK RNA, but not when using a non-targeting control crRNA. Consistent with previous reports, the DT960 induced RNA foci, highlighted with dCas13b-eGFP, co-localized with an mCherry-MBNL1 fusion protein (FIG. 19D). This technology, which is named HiLightr, which has the potential to greatly simplify the visualization of disease-associated RNA foci in fixed and in live cells. Further, these data show that dCas13, when localized with the Ty1 NLS, has the potential to target mRNAs prior to and following 3' end processing, with the goal of preventing or editing these RNAs to alleviate their cytotoxicity.

These data support the conclusion that targeted RNA editing by CRISPR-Cas13 is a potential therapeutic approach to preserve DMPK expression and prevent transcription of toxic CUG expansion RNA.

Targeted Alternative Cleavage and Polyadenylation of Human DMPK Transcripts.

Regulation of the human DMPK locus is complex, with at least six major alternatively spliced isoforms and at least 4 potential alternative polyadenylation sites. The longest DMPK isoform encodes a transcript containing 15 exons, with the site of $CUG^{exp}$ RNA occurring in the 3' UTR of the terminal exon. Successful completion of the following studies identify Postscriptr guide RNAs which induce efficient cleavage and polyadenylation of human DMPK isoforms and which prevent downstream transcription of $CUG^{exp}$ RNA. The data presented herein demonstrates that Postscriptr can induce cleavage and polyadenylation of one alternative DMPK isoform in HEK293T cells which terminates upstream of the site of CUG expansion in human cells. Guide-RNAs are designed to induce targeted cleavage and polyadenylation of all naturally occurring APA-regulated isoforms along the DMPK locus in an effort to both preserve normal DMPK function while sufficiently preventing downstream $CUG^{exp}$ RNA transcription.

Identification of major DMPK isoforms regulated by APA in fetal and adult human tissues using 3' RACE. Annotation of the alternative polyadenylation of human DMPK transcripts is poorly characterized across different human tissues, which may utilize different alternative cleavage and polyadenylation sites. While Postscriptr does not require and endogenous PAS site to induce targeted polyadenylation, Postscriptr targeting at endogenous APA sites allows for more efficient and precise cleavage, which may be aided by intrinsic PAS sequences at endogenous APA sites. APA regulated DMPK isoforms are identified in human fetal and adult tissues and their precise cleavage sites, which aids in the design and targeting of Postscriptr guide-RNAs. Using RACE-ready Marathon cDNA (Clontech) (fetal and adult: skeletal muscle, brain, lung and stomach), 3'RACE is performed using nested primers specific to exon 11 of human DMPK, which represents the most 5' sequence present within the human mutant DMPK construct and inducible DM1 mouse model. PCR-generated 3'RACE products are separated using agarose gel-electrophoresis, subcloned using TOPO cloning, sequenced and mapped to identify their cleavage site.

Assess Postscriptr editing efficiency of DMPK isoforms by tiling CRISPR guide-RNAs. Unlike Cas9 which requires an adjacent protospacer motif (PAM) for efficient binding and cleavage, Cas13b does not require flanking sequences for RNA targeting. This allows for efficient tiling of guide-RNAs across a sequence to identify sites with the highest binding efficiency. For each APA isoform 10 guide-RNAs are designed tiling every 5 nucleotides (ranging from −50 to −100) relative to the site of RNA cleavage. Targeting this sequence range is most active for Postscriptr editing. In addition to using Postscriptr to induce APA isoforms of DMPK, mutant DMPK RNAs are directly targeted using CAGx9 guide-RNA. Since Postscriptr has cleavage activity, and dCas13-GFP protein can be targeted to nuclear foci, this approach allows for cleavage of $CUG^{exp}$ RNA foci or promote processing and export of DMPK mRNAs. However, this targeting approach could lead to off-target cutting of other human mRNAs containing short CUG-motifs. Alternatively, targeting of dCas13 alone (without a fusion domain) to $CUG^{exp}$ RNA provides steric hindrance and prevent binding and sequestering of MBNL proteins to the toxic CUG repeats, which itself could be therapeutically beneficial.

PspCas13b guide-RNA design and cloning. Tiling of guide-RNAs are necessary to identify sequences which are most active, which can be influenced by RNA folding, stability, or target RNA accessibility. crRNA sequences with more than 3 consecutive Ts in their target sequence are avoided, as this can significantly prevent expression from the human U6 pol III promoter, which use poly T as a terminator. Guide-RNAs are cloned by annealing complementary oligonucleotides into pC0043 using standard cloning techniques.

Testing guide-RNA efficiency using the sfGFPapa reporter. The sfGFP fluorescent reporter developed to detect APA (sfGFPapa) contains an internal cloning site with sequence overhangs that allow for guide-RNAs to be inserted into the reverse orientation within the rabbit beta globin intron, downstream of the sfGFP open reading frame. Cloning guide-RNAs into this reporter allows for self-targeting and activation of the reporter to determine the activity of each guide-RNA. Using this strategy, guide-RNAs are screened to identify those which are most efficient, measured as intensity of green fluorescence relative to an internal SV40-Luciferase expression vector as a control for transfection efficiency. Fluorescence is measured on a BMG FluoStar Optima Plate reader and guide-RNAs yielding the greatest signal are selected for further analysis.

Testing guide-RNAs on $CUG^{exp}$ DMPK RNA in COS7 cells using 3'RACE. Efficient guide-RNAs are further tested for their ability to target and induce cleavage and polyadenylation of the mutant human DMPK expression plasmid, DT960, which encodes 960 CUG repeats in the context of human DMPK exons 11-15. Plasmids encoding the Postscriptr fusion protein, guide-RNAs and DT960 plasmid are co-expressed into COS7 cells for 24 hours, after which total RNA are isolated using TRIzol for subsequent analysis by 3' RACE using a custom poly (T) oligonucleotide. The outcomes of these studies demonstrate that Postscriptr editing of mutant DMPK RNAs can occur in the presence of expanded downstream CUG repeats, which could alter downstream sequence elements required for 3' end processing, or cause mis-localization or folding of the mutant DMPK transcripts such that 3' end processing is inhibited. Recent studies suggest that mutant DMPK transcripts, which are exclusively nuclear, are polyadenylated and share a similar size distribution in their poly(A) tails compared to normal DMPK transcripts, suggesting that 3' end processing of mutant DMPK transcripts is not broadly inhibited.

Postscriptr editing efficiency. Using total RNA generated in above, cDNA are generated using random hexamers and Superscript III, according to manufacturer's protocol. Editing efficiency of Postscriptr induced APA of mutant DMPK transcripts are assessed using qRT-PCR using a primer set specific to exons upstream of the guide-RNA and another set downstream of the site of CUG expansion in the DMPK 3' UTR. For efficient guide-RNAs, equivalent levels of human DMPK transcripts upstream of the target site but significantly reduced levels downstream are observed, indicating preservation of DMPK mRNA but premature termination of transcription. The guide-RNAs which are most effective are further tested for the ability to rescue DMPK expression and reduce $CUG^{exp}$ related toxicity.

Determination of Whether Postscriptr Rescues Nucleocytoplasmic Shuttling of DMPK mRNA and Expression.

Retention of mutant DMPK mRNAs in nuclear foci is the predominant mechanism underlying decreased DMPK expression in DM1 patients. Consistent with previous reports, a luciferase transgene containing the human DMPK 3' UTR containing a large $CUG^{exp}$ repeat significantly decreases luciferase expression (>90%), compared to a construct with only 12 CUG repeats (FIG. 20). It is determined if Postscriptr editing can rescue the normal nucleocytoplasmic shuttling of mutant DMPK mRNA and expression using cell based assays.

Nucleocytoplasmic Shuttling of DMPK. Since reliable antibodies for human DMPK do not exist, it is first determined if Postscriptr editing rescues the nucleocytoplasmic shuttling of mutant DMPK RNAs. Postscriptr editing components are co-transfected with the DT960 mutant DMPK expression plasmid in COS7 cells for 24 hours, after which cytoplasmic and nuclear RNAs are fractionated. qRT-PCR using sybr primers specific to upstream DMPK exons 11-12 are used to determine the ratio of nuclear vs cytoplasmic DMPK RNA. Guide-RNAs which increase the relative cytoplasmic levels of DMPK, relative to non-targeting guide-RNAs, are selected for further testing.

Rescue of Luciferase-DMPK transgene expression. For guide-RNAs which target the CUG repeats, it is determined if Postscriptr can rescue the expression of a Luciferase-DMPK transgene encoding 960 CUG repeats (pGL3P-DT960) relative to non-targeting guide-RNA. Luciferase activity and fluorescence is measured on a BMG FluoStar Optima plate reader. Guide-RNAs yielding the greatest signal are selected for further analysis.

Determination of Whether Postscriptr Prevents Nuclear RNA Foci Formation and MBNL Mis-Localization.

Perhaps the most striking feature of DM1 pathology is the presence of nuclear foci containing $CUG^{exp}$ RNA, which co-localize with and functionally deplete MBNL family proteins. It is determined if Postscriptr can reduce or abolish RNA foci and prevent sequestering of MBNL1. Postscriptr guide-RNAs targeting human DMPK isoforms are co-transfected with the mutant DMPK expression plasmid, DT960, in C2C12 myoblast cells for 24 hours. Cells are then analyzed using combined fluorescent in situ hybridization (FISH) to detect $CUG^{exp}$ RNA foci and immunofluorescence (IF) to detect MBNL1. Postscriptr co-transfected with a non-targeting guide RNA and DT960 is used as a positive control and without DT960 as a negative control for RNA foci and MBNL1 co-localization. Combined FISH/IF is performed as follows. Briefly, cells cultured on glass coverslips are fixed in 4% PFA for 15 min and washed two times with PBS. Fixed cells are permeabilized for 10 min in 0.5% Triton X-100 in PBS and washed three times with PBS before pre-hybridization in 40% DMSO, 40% formamide, 10% BSA (10 mg/ml), 2×SCC for 30 min. Coverslips are then hybridized for 2 hours in hybridization buffer (40% formamide, 10% DMSO, 2×SCC, 2 mM vanadyl ribonucleoside, 60 µg/ml tRNA, 30 µg/ml BSA and 0.75 µg 8×CAG-Cy3 DNA oligonucleotide probe (IDT). For subsequent IF, coverslips are washed twice in 2×SCC/50% formamide, 2×SCC and PBS. MBNL1 is detected using an anti-MBNL1 antibody (clone 3A4, Santa Cruz Biotechnology) for 2 hours, washed twice in PBS, followed by incubation with a goat anti-rabbit secondary antibody conjugated with Alexa-Fluor 488 for 1 hour. Coverslips are mounted using Vectashield with DAPI (Vector Biolabs) and imaged using confocal microscopy. It is determined whether Postscriptr decreases the number of RNA foci per cell, and whether foci co-localize with MBNL1. At least 15 cells are counted from at least 3 independent experiments.

The regulation of the human DMPK locus is complex, with multiple splice isoforms already annotated. Thus, the intronic sequence downstream of exon 12 is also targeted, preserving most of DMPK's coding potential. For CRISPR-Cas9 systems, off-target editing can be problematic given their ability to tolerate single or double sequence mismatches, their short single 20 nucleotide guide-RNAs and the potential target population is large (~3 billion base pair human genome). However, potential off target editing for CRISPR-Cas13 systems are less problematic, since they are guided by longer ~30 nucleotide guide-RNAs and the target population is much smaller (only transcribed RNAs, targeted antisense). The BLAST algorithm is utilized to identify and limit any potential off targeting. An analysis of the expression of other major short CUG repeat containing mRNAs is included to determine the off-target potential of this method. As the guide-RNAs are designed to target exon sequences, which are present in spliced DMPK transcripts, Postscriptr editing can target pre-existing mutant DMPK transcripts in the nucleus over a broad period of time. Due to the limits of cell culture and transient transfections, these experiments are analyzed at 24 and 48 hours.

Determination of Whether Postscriptr Mitigates Disease Outcomes in a Humanized Mouse Model of DM1.

Herein, viral delivery and expression of Postscriptr editing components in vivo are used to determine the efficacy of targeted APA of DMPK isoforms as a therapeutic approach to correct DM1-associated cellular and molecular pathologies. Guide-RNAs targeting a DMPK APA isoform and a non-targeting control guide-RNA (3 total) are tested.

Assess the In Vivo Efficiency of Postscriptr Targeting of DMPK DM1 Transcripts in Skeletal Muscle.

For these studies, a previously established inducible DM1 mouse model is used which expresses 960 CUG repeats in the context of human DMPK exons 11-15 (TREDT960I) (FIG. 21). As described above, the same fragment of mutant DMPK (DT960) is used to design and test Postscriptr guide-RNAs. This large fragment of the human DMPK locus allows for Postscriptr targeting at multiple sites along the DMPK locus to test both artificial and endogenous alternatively spliced and polyadenylated DMPK isoforms. In this model, induction of the mutant DMPK transgene at postnatal day 1 resulted in DM1 related phenotype at 10 weeks of age, including myopathy, CUG nuclear RNA foci co-localized with MBNL1, and characteristic DM1 splicing defects. Interestingly, this model showed that these pathologies are reversible, suggesting that terminating transcription of $CUG^{exp}$ RNA is sufficient for therapeutic benefit.

Inducible mouse model of DM1. TREDT960I mice were obtained from The Jackson Laboratory. To induce mutant DMPK expression in skeletal muscle, TREDT960I homozygous mice are crossed with a hemizygous transgenic mouse containing and rtTA expression cassette under the control of the human skeletal actin promoter (HSA-rtTA). This generates bi-transgenic offspring (TREDT960I and HSA-rtTA) and single transgenic (TREDT960I) controls lacking the HSA-rtTA. [Male$^{TREDT960I/TREDT960I}$×Female$^{HSA-rtTA/+}$=Male or female$^{TREDT960I/+;\ HSA-rtTA/+}$ and male or female$^{TREDT960I/+;\ +/+}$.] All littermates are induced with 2.0 g/kb doxycycline (dox) chow (Bio-Serv) at postnatal day 1 (P1) through nursing dam, however, only bi-transgenic animals express the mutant DMPK transgene ($CUG_{960}$) (FIG. 21A and FIG. 21B). This breeding scheme facilitates early induction by dox without necessitating genotyping prior to dox treatment. TREDT960I mice are maintained as homozygous intercrosses, which are viable, and HSA-rtTA mice are maintained as hemizygous mice crossed to wild type.

Lentiviral production of Postscriptr editing components. The CRISPR-Cas9 lentiviral transfer plasmid LentiCRISPR V2 is modified to encode the PspCas13 compatible guide-RNA cassette and the dPspCas13-NUDT21 fusion protein (FIG. 21C). Additionally, an mScarlet-i (mSi) red fluorescent protein with a P2A cleavage peptide is inserted upstream of the dPspCas13b-NUDT21 fusion protein to aid in identifying transduced cells. Lentiviral particles are produced using low passage Lenti-X 293T cells (Clontech, 632180) transiently transfected with the Postscriptr lentiviral vector, psPax2 (packaging plasmid) and pMD2.G, which contains the VSV-G envelope protein allowing broad transduction of all cell types. To allow for robust skeletal muscle restricted expression of the Postscriptr fusion protein, the broadly expressing EF1 alpha promoter was replaced with the potent mini Muscle Creatine Kinase promoter, CK8e. Guide-RNAs are cloned into this vector which are used to generate lentiviral particles for expression of Postscriptr editing components in skeletal muscle of the $CUG_{960}$ inducible DM1 mouse model. Lentiviral-containing supernatant is concentrated using Lenti-X Concentrator and titrated using transduction of COST cells and FACS analysis measuring % mScarlet-i expressing cells. To limit variability, all Postscriptr lentiviral particles for an experiment are produced for each guide-RNA and stored in single use aliquots at −80° C.

Lentiviral Delivery. At P3, 1.6e8 TU of Postscriptr lentiviral particles are injected via the superficial temporal vein for 6 male and 6 female $CUG_{960}$ mice, and an equal number of male and female single transgenic TREDT960I controls (all on dox). Transduction in neonatal mice significantly reduces the amount of lentivirus need to robustly transduce muscle. These experiments are performed using Postscriptr Lentivirus containing non-targeting guide-RNAs, a DMPK targeting guide-RNAs or a CUG targeting guide-RNA. In a smaller cohort, 3 male and 3 female $CUG_{960}$ mice, and an equal number of male and female single transgenic TREDT960I controls (all on dox), which do not receive lentiviral transduction, are generated to verify that lentiviral transduction or non-targeted Postscriptr expression alone has an effect on DM1 progression.

Tissue harvest and muscle weights. At 10 weeks of age (10 weeks post induction of $CUG_{960}$ expression and Postscriptr lentiviral delivery), total body weight is recorded and hindlimb muscles (gastrocnemius, quadriceps and tibialis anterior (TA) muscles) are harvested, weighed, and normalized to tibia length. Red fluorescence, from expression of the mScarlet transgene, is monitored using a stereo fluorescent dissecting scope at the time of dissection to verify lentiviral transduction and expression in skeletal muscle. Right-side muscles are fixed in 4% formaldehyde in PBS and processed using routine methods for paraffin histology. Left-side muscles are snap frozen in liquid nitrogen for further RNA and protein analyses. Hindlimb muscles from $CUG_{960}$ mice on dox weigh significantly less than single transgenic mice on dox. Efficient Postscriptr editing preserves muscle weights and prevents wasting in $CUG_{960}$ muscle and shows no significant effects on single transgenic mice (TREDT960I only).

RNA isolation and generation of cDNA. Skeletal muscles snap frozen in liquid nitrogen are pulverized using a Bessman Tissue Pulverizer to obtain whole tissue homogenates. For RNA isolation, pulverized skeletal muscle homogenates are added to 1 ml of ice-cold TRIzol and homogenized in a VWR Beadmill using 2.8 mm ceramic beads. Total RNA is extracted by isopropanol precipitation and cDNA is generated using SuperScriptr III (ThermoFisher) for qRT-PCR or 3' RACE.

3' RACE and qRT-PCR to determine efficacy of site specific cleavage and polyadenylation. Using the 3' RACE and qRT-PCR strategies described above, the efficacy of Postscriptr-mediated targeted cleavage and polyadenylation of the mutant DMPK transgene in skeletal muscle (gastrocnemius) of $CUG_{960}$ mice is determined. Mutant DMPK transgene expression is verified by qRT-PCR using primers upstream of the Postscriptr target site to ensure adequate expression of the mutant DMPK allele across genotypes.

Assess the Histological and Cellular Remodeling Changes in Postscriptr-Edited DM1 Skeletal Muscles.

At 10 weeks post-induction by dox, $CUG_{960}$ mice contain centralized nuclei and decreased myofiber cross-sectional area. The efficacy of Postscriptr editing in muscle is determined using these parameters.

Histological analyses, myofiber cross-sectional area, and centralized nuclei. Haematoxylin and eosin (H&E) staining of transverse histological sections of the gastrocnemius muscle of at least three different mice is performed. Quantitative comparisons and statistical analyses are performed comparing the ratio of myofibers with centralized nuclei in hindlimb muscles. At least three different sectional levels are compared, from 3 different mice of each genotype. Postscriptr treated $CUG_{960}$ mice showing a less severe phenotype, have decreased ratio of myofibers with centralized nuclei and preserved myofiber cross sectional area (quantified using ImageJ).

In vivo delivery and expression of Postscriptr fusion protein. The percentage of myofibers expressing the dPspCas13b-NUDT21 fusion protein and nuclear localization is quantified using an anti-FLAG antibody using immunohistochemistry on sections. Additionally, the effects of Postscriptr editing on individual myofibers (% centralized nuclei and cross-sectional area) within a muscle are compared to non-Postscriptr expressing myofibers within the same muscle.

Quantifying Corrected DM1-Associated RNA Splicing Defects in Edited Muscles Using RNA-Sequencing.

For reasons which are unclear, the effects of misplicing in mouse DM1 models vary significantly across models. This may be due to the relative expression of the mutant transgene, the nature of the CUG repeat (interrupted vs all tandem), or the size of the CUG expansion. The inducible DM1 mouse model used for these studies has been reported to have broad, but mild splicing abnormalities in comparison to other models.

Detection of alternative splicing by RT-PCR. The relative percentage of alternative splicing is determined using RT-PCR in Postscriptr treated vs non-treated gastrocnemius muscle from bi-transgenic $CUG_{960}$ mice (male and female, at least 3 per genotype). These genes include Atp2a1 exon 22, Bin1 exon 11, and Cacna1s exon 29, which were among the most robust splice events identified in these mice. Quantification of relative isoform splicing is measured using a BioRAD ChemiDocMP, and Postscriptr dependent rescue of splice events is measured relative to a mice treated with a negative control guide-RNA.

Targeted RNA sequencing. Further, the effect of Postscriptr editing on global changes in alternative splicing is compared by performing targeted RNA sequencing to examine 36 DM1-specific splicing events. Briefly, multiplex RT-PCR is performed with the inclusion of bar codes and sequencing adaptors on each sample, which is pooled and sequenced (Illumina) and analyzed to determine fractional inclusion for each alternative exon in each sample. Results are highly reproducible ($r^2 > 0.98$ between runs for most splice events), and floor- and ceiling-effects seen with gel analysis are avoided.

Perform Physiologic Testing of Skeletal Muscle for Postscriptr Dependent Rescue of Muscle Strength.

Muscle function is directly assessed using well-established physiological methods to determine if Postscriptr editing significantly improves exercise performance and muscle function. These studies are carried out using the Postscriptr guide-RNA which was most effective in mitigating DM1 symptoms and a non-targeting guide.

Exercise performance of Postscriptr rescued $CUG_{960}$ mice. To measure exercise performance and indirectly skeletal muscle function in Postscriptr rescued $CUG_{960}$ mice, 9 $CUG^{960}$ bi-transgenic and single transgenic mice transduced with Postscriptr lentiviral vectors encoding guide-RNAs (targeting or non-targeting, using the breeding and lentiviral targeting and delivery scheme described above) are subjected to forced running to exhaustion on a treadmill (Exer-6M, Columbus Instruments, 10% incline) at 10 weeks of age post-induction, according to the running protocol. Based on the dystrophic-like phenotype observed at 10 weeks of age in $CUG_{960}$ mice, $CUG_{960}$ mice show severe defects in exercise performance, measured as total distance run. Mice treated with Postscriptr targeting DMPK significantly increase total distance run, versus non-targeted controls.

Skeletal muscle contraction assays. Muscle strength and fatigability is assessed in 10-week old $CUG_{960}$ mice edited with Postscriptr using either non-targeting or DMPK guide-RNAs (4 mice per group). Excised fast-twitch extensor digitorum longus (EDL) and slow-twitch soleus (Sol) muscles are analyzed using an ASI muscle contraction system (Aurora Scientific, Aurora, ON, Canada) equipped with a 300C-LR dual mode force transducer and a 701C stimulator. The muscle is submerged horizontally in oxygenated Ringer's solution (25° C.), and two platinum electrodes are used to stimulate the muscle with 0.2 ms square wave pulses. Specific force ($kN/m^2$) is calculated based on the fiber length, muscle mass, and maximum isometric tetanic force. Following the analysis of contractile properties, the fatigue protocol is initiated using both EDL and Sol muscle. The protocol consists of 200 ms stimulation trains of 0.2 ms square pulses delivered at a predetermined frequency, voltage, and muscle length to give maximum isometric titanic force. Stimulation trains are delivered at 0.1-0.2 Hz for 0, 1, 2, 5, 15, and 30 min. The ability of muscle to recover from fatigue is determined by delivery of 200 ms stimulation trains every 5 min for one hour following the fatigue protocol. The rate of muscle relaxation of Postscriptr edited muscle is greater than wild type littermates and $CUG_{960}$ mice have decreased rates of muscle contraction. Skeletal muscles which show robust Postscriptr expression are verified and compared using mScarlet fluorescence.

Other well-established mouse models of DM1 are also utilized, such as the DMSXL or HSALR transgenic lines. DMSXL transgenic mice carry a cosmid fragment isolated from a DM1 patient, containing the entire human DMPK gene, 1,200 CTG repeats, and >10 kb of flanking sequences. Despite the long repeat expansion, these animals do not exhibit a robust muscle phenotype, because in skeletal muscle the DMPK transgene expression is ~4-fold lower than endogenous Dmpk. This model is useful in determining Postscriptr prevention of RNA foci formation in vivo or rescue of nucleocytoplasmic shuttling of the human DMPK mRNA. HSALR mice have a severe muscle phenotype but carry 250 CUG repeats in the 3' UTR of a genomic fragment encoding human skeletal acting (HSA), which prevents guide-RNA targeting strategies from being directly translatable to human patients. However, this mouse model is well-suited for testing guide-RNAs directly targeting the CUG repeats or by using guide-RNAs targeting the HSA mRNA.

Gender Specific Differences in Phenotypic Severity in DM1. While the molecular basis remains elusive, clear gender-specific differences in phenotype severity has been observed for DM1. Specifically, male DM1 patients are more likely to present with classic DM1 symptoms, including cognitive impairment, muscle weakness, myotonia, respiratory and cardiac conduction defects, and female patients are more likely to show symptoms involving non-muscle tissues, including cataracts, obesity, and thyroid involvement. Given the importance of gender-specific differences in DM1, both genders are examined mouse studies.

Statistical Analysis. Students t-test are applied to compare single treatments. Multiple physiological and biochemical assays are analyzed using one-way or repeated measures ANOVA.

In summary, the development of Postscriptr RNA editing has provided the capability to manipulate mammalian 3' end processing post-transcriptionally, which in the context of DM1 or other toxic gain-of-function RNA diseases, offers a novel approach for the prevention of disease outcomes. The data presented herein demonstrates that Postscriptr is sufficient to induce targeted cleavage and polyadenylation of endogenous human DMPK transcripts. This approach is used to determine if Postscriptr targeting of DMPK can rescue DM1-associated cytotoxicity and skeletal muscle function and disease pathogenesis in a mouse model of DM1. The programmable nature of Postscriptr allows this approach to be readily adapted to treat other toxic RNA repeat diseases, including Myotonic Dystrophy type 2 (DM2), Amyotrophic lateral sclerosis (ALS), Huntington's disease-like 2 (HDL2), Spinocerebellar ataxias 8, 31 and 10 (SCAB, -31, -10) and fragile X-associated tremor ataxia syndrome (FXTAS).

Example 6: Targeting Toxic Nuclear RNA Foci by CRISPR-Cas13

The data presented herein demonstrates that RNA-binding CRISPR-Cas13, with a robust non-classical nuclear localization signal, can be efficiently targeted to toxic nuclear RNA foci for either visualization or cleavage, approaches termed herein hilightR and eraseR, respectively. HilightR combines catalytically dead Cas13b (dCas13) with a fluorescent protein to directly visualize CUG repeat RNA foci in the nucleus of live cells, allowing for quantification of foci number and observation of foci dynamics. EraseR utilizes the intrinsic endoribonuclease activity of Cas13b, targeted to nuclear CUG repeat RNA, to disrupt nuclear foci. These studies demonstrate the potential for targeting toxic nuclear RNA foci directly with CRISPR-Cas13 for either the identification or treatment of Myotonic Dystrophy Type 1. The efficient and sequence programmable nature of CRISPR-Cas13 systems allows for rapid targeting and manipulation of other human nuclear RNA disorders, without the associated risks of genome editing.

Bacterial derived CRISPR-Cas13 systems bind specifically to RNA and function as endoribonucleases to cleave RNA, bypassing the risk of germline editing that is associated with DNA-binding CRISPR-Cas endonucleases. Single residue mutations within the two nuclease domains of Cas13 generate a catalytically deactivated enzyme (dCas13), which retains programmable RNA binding affinity in mammalian systems without the requirement for PAM sequences for efficient targeting. Due to their large size and lack of intrinsic localization signals, both Cas9 and Cas13 fusion proteins are inefficiently localized to the mammalian nucleus. In our recent pre-print manuscript describing a novel adaptation of CRISPR-Cas13 for inducing targeted cleavage and polyadenylation of RNA, a non-classical nuclear localization signal (NLS) derived from the yeast Ty1 retrotransposon was identified which promotes robust nuclear localization of Cas13. The powerful activity of the Ty1 NLS suggested that efficient targeting of nuclear RNAs could be achieved for both visualization and cleavage with CRISPR-Cas13.

Figure 22:
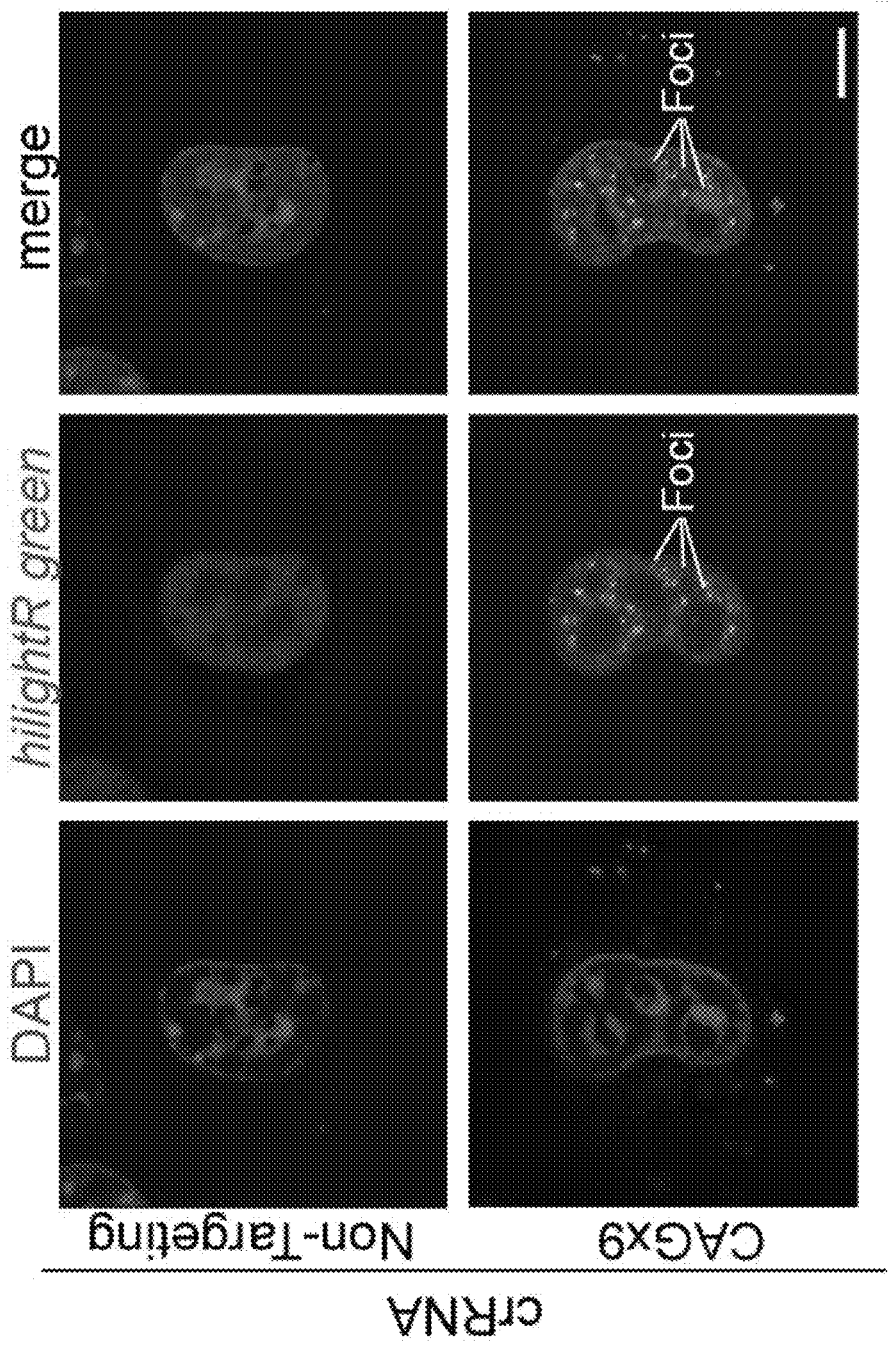
FIG. 22, comprising
Figure 25:
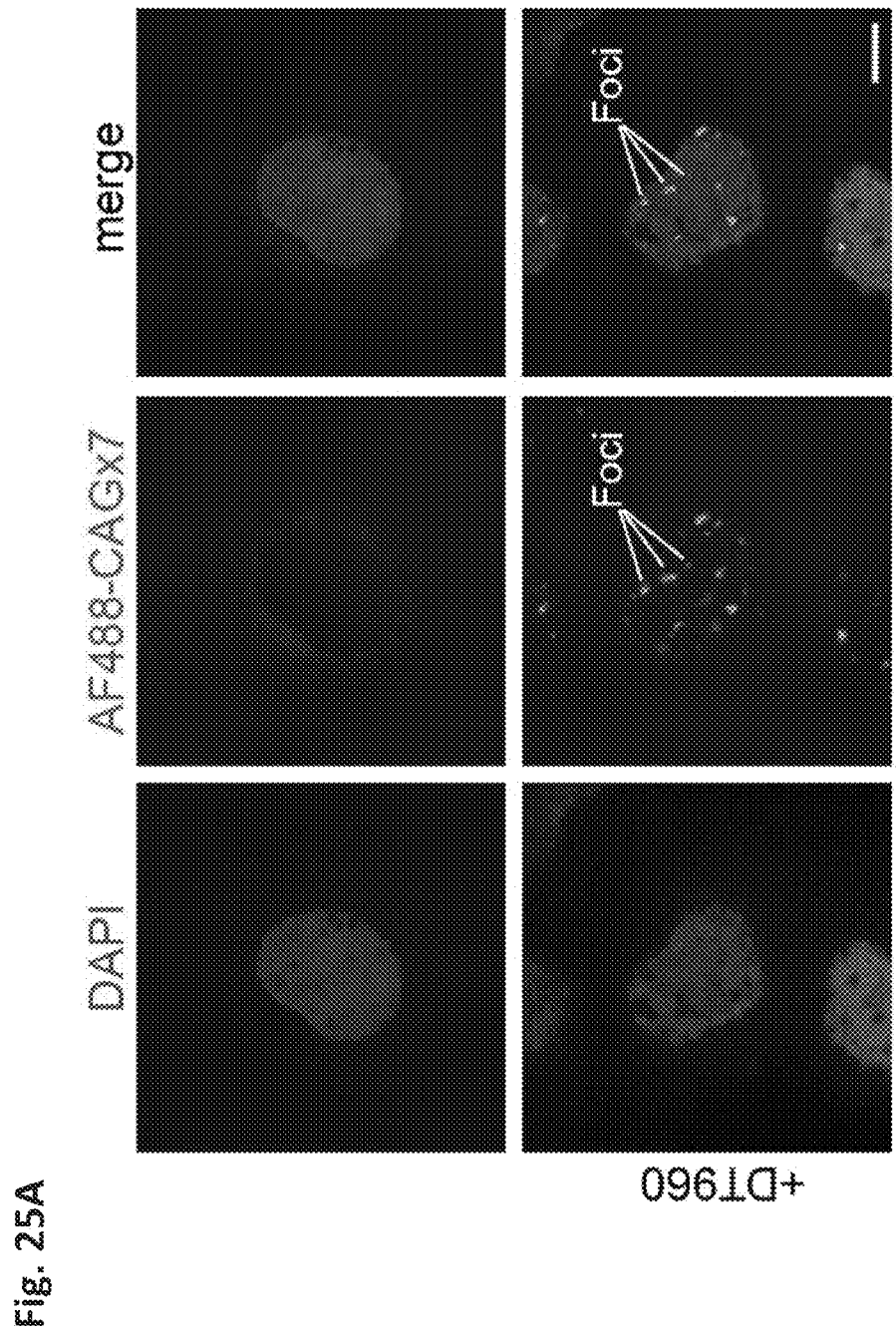
FIG. 25, comprising
Figure 25:
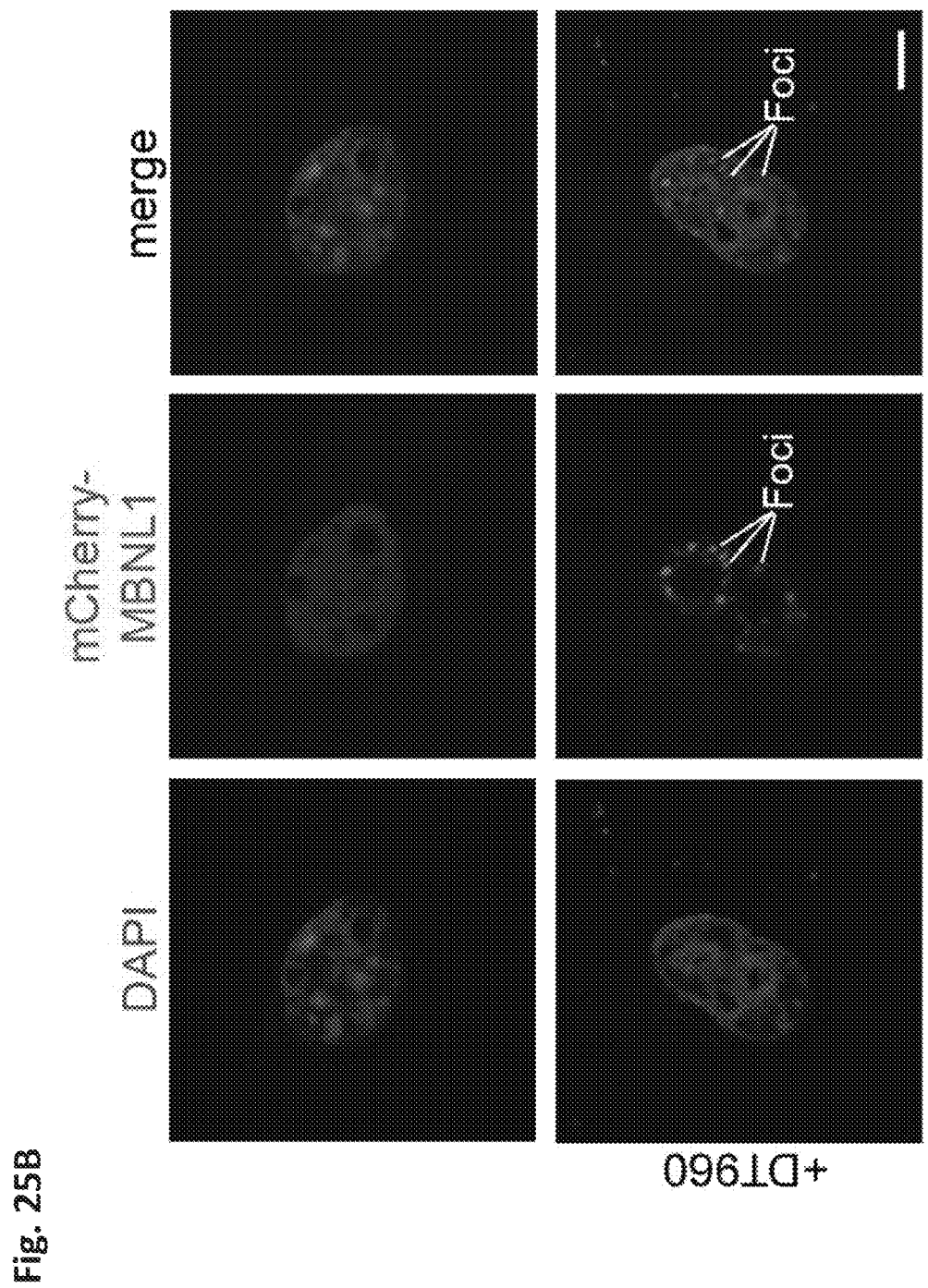
Figure 25:
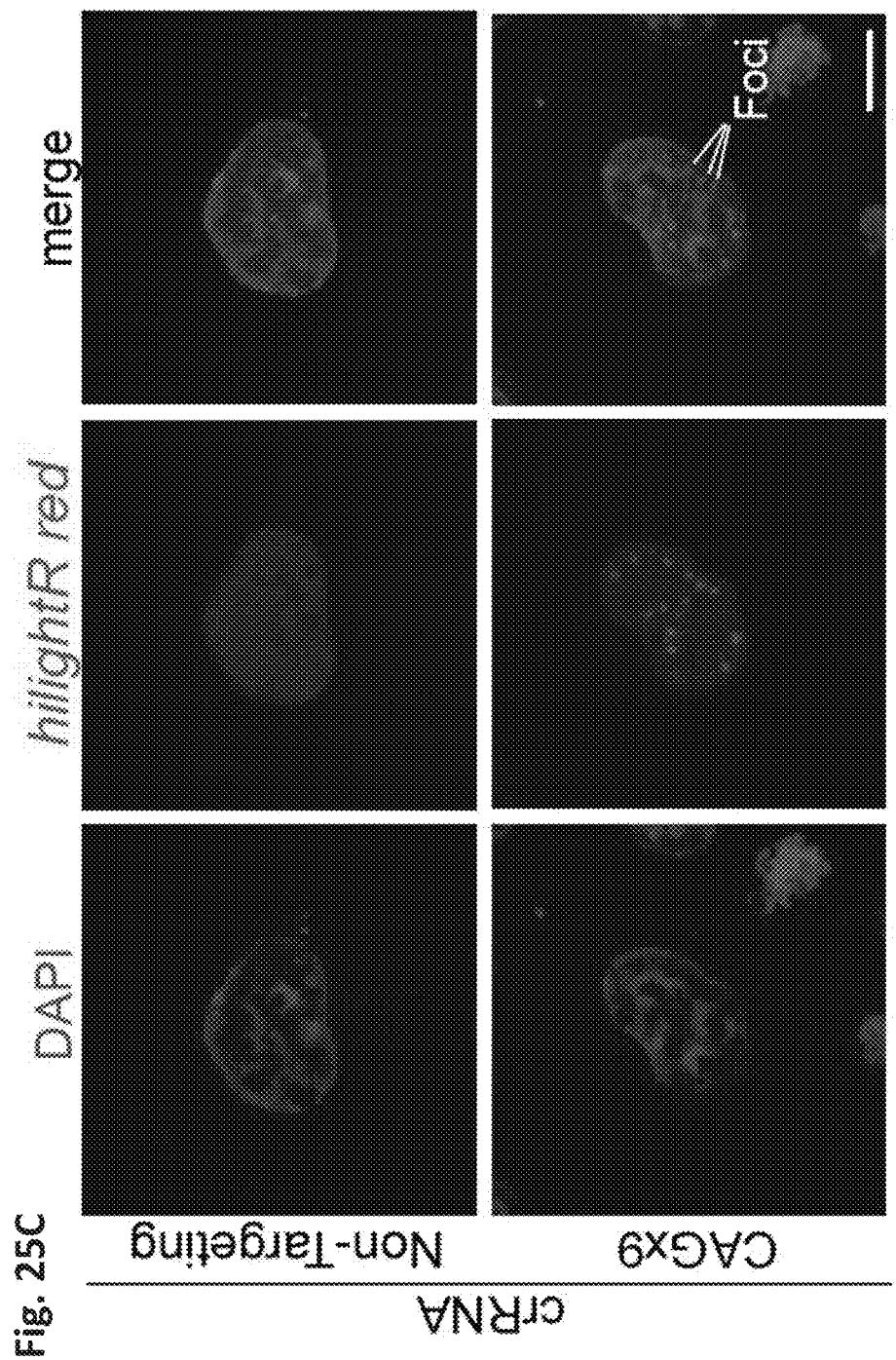

Toxic RNA foci are the cellular hallmark of DM1. To visualize nuclear RNAs using CRISPR-Cas13, a fusion protein was designed combining the catalytically dead Type VI-B Cas13b enzyme from *Prevotella* sp. P5-125 (dPspCas13b) with either a C-terminal enhanced Green Fluorescent Protein (eGFP) or red fluorescent protein, mCherry (FIG. 22A). A 3×FLAG epitope tag (F) and Ty1 nuclear localization sequence (Ty1 NLS) were added to the N-terminus of the dPspCas13b fusion proteins to promote efficient nuclear localization, hereinafter referred to as hilightR green or hilightR red (FIG. 22A). Toxic RNA foci are the cellular hallmark of DM1 and can be induced in many cell types by the expression of transgenes expressing expanded CUG repeats. To mimic the nuclear RNA foci found in patients with DM1, a vector containing 960 CUG repeats in the human DMPK 3' UTR (DT960) was utilized (FIG. 22B)[23]. The DT960 construct is sufficient to recapitulate RNA foci formation in cells and can be detected by Fluorescent In Situ Hybridization (FISH) using an antisense (CAG) repeat probe or with an mCherry-MBNL1 fusion protein (FIG. 26A and FIG. 26B). To target hilightR fusion proteins to CUG repeats, a PspCas13b-compatible crRNA containing an antisense CAG repeat target sequence (CAGx9) was designed, which is predicted to hybridize with 9 CUG repeats (FIG. 22C). Guided by the CAGx9 repeat crRNA, hilightR green and red were completely nuclear localized and highlighted nuclear RNA foci generated by the DT960 vector (FIG. 22D and FIG. 25). In contrast, co-expression of hilightR constructs with a non-targeting crRNA resulted in broad, un-localized nuclear fluorescence (FIG. 22D and FIG. 25C).

Figure 26:
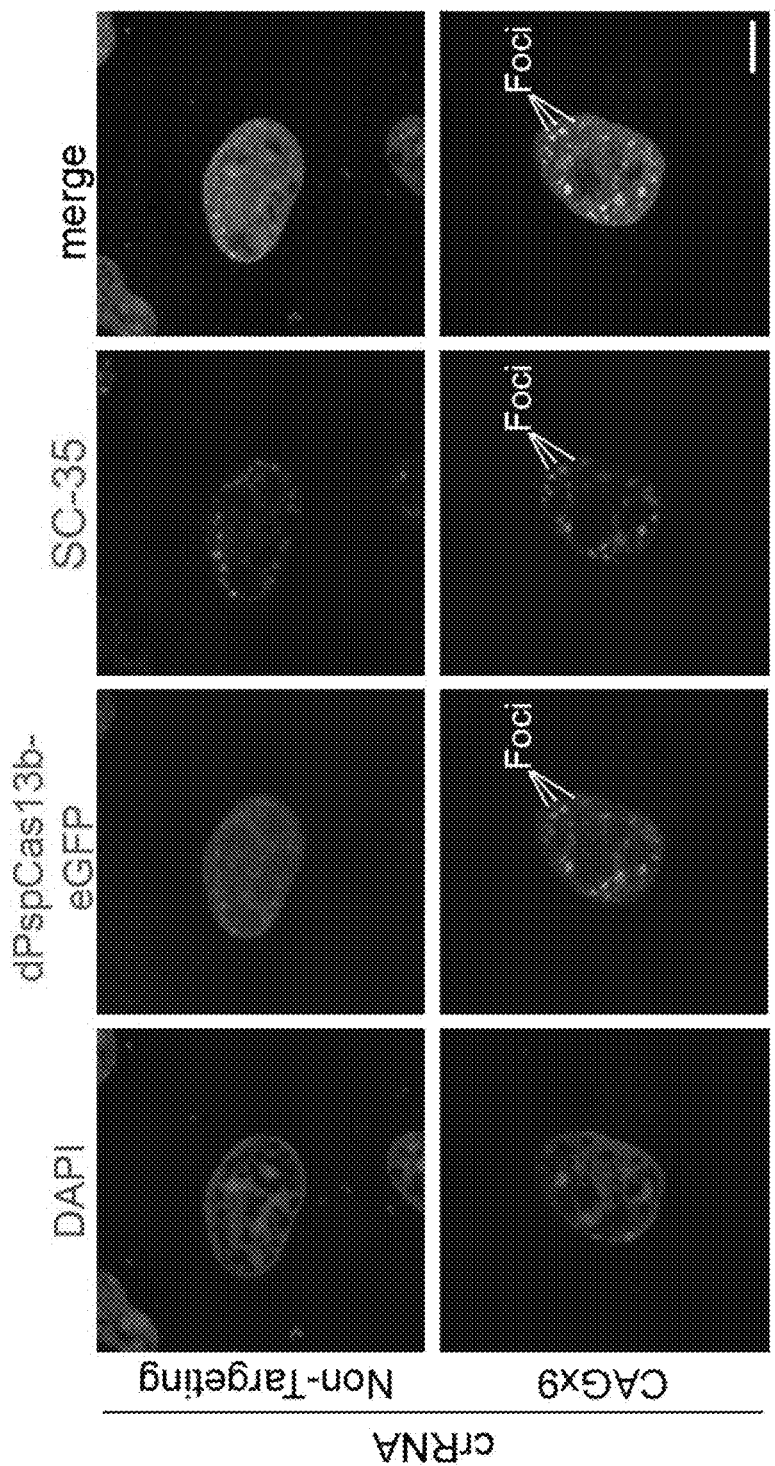
FIG. 26 depicts experimental results demonstrating co-localization of hilightR green with splicing speckles. In agreement with previous reports, $CUG^{exp}$ RNA foci marked by hilightR green targeted with a CAGx9 crRNA, co-localized with splicing speckles, as detected using an anti-SC-35 antibody. Scale bars, 10 μm.

Nuclear foci labeled with hilightR green co-localized with an Alexa Fluor 488-conjugated CAG oligonucleotide probe (AF488-CAGx7), detected using FISH (FIG. 23A). Consistent with previous reports, nuclear foci labeled with hilightR green co-localized with MBNL1 protein, detected using an mCherry-MBNL1 fusion protein, and partially co-localized with splicing speckles, detected with an antibody specific for SC-35 (FIG. 23B and FIG. 26). These results demonstrate that hilightR accurately detects $CUG^{exp}$ RNA foci.

Figures 24, 24A:
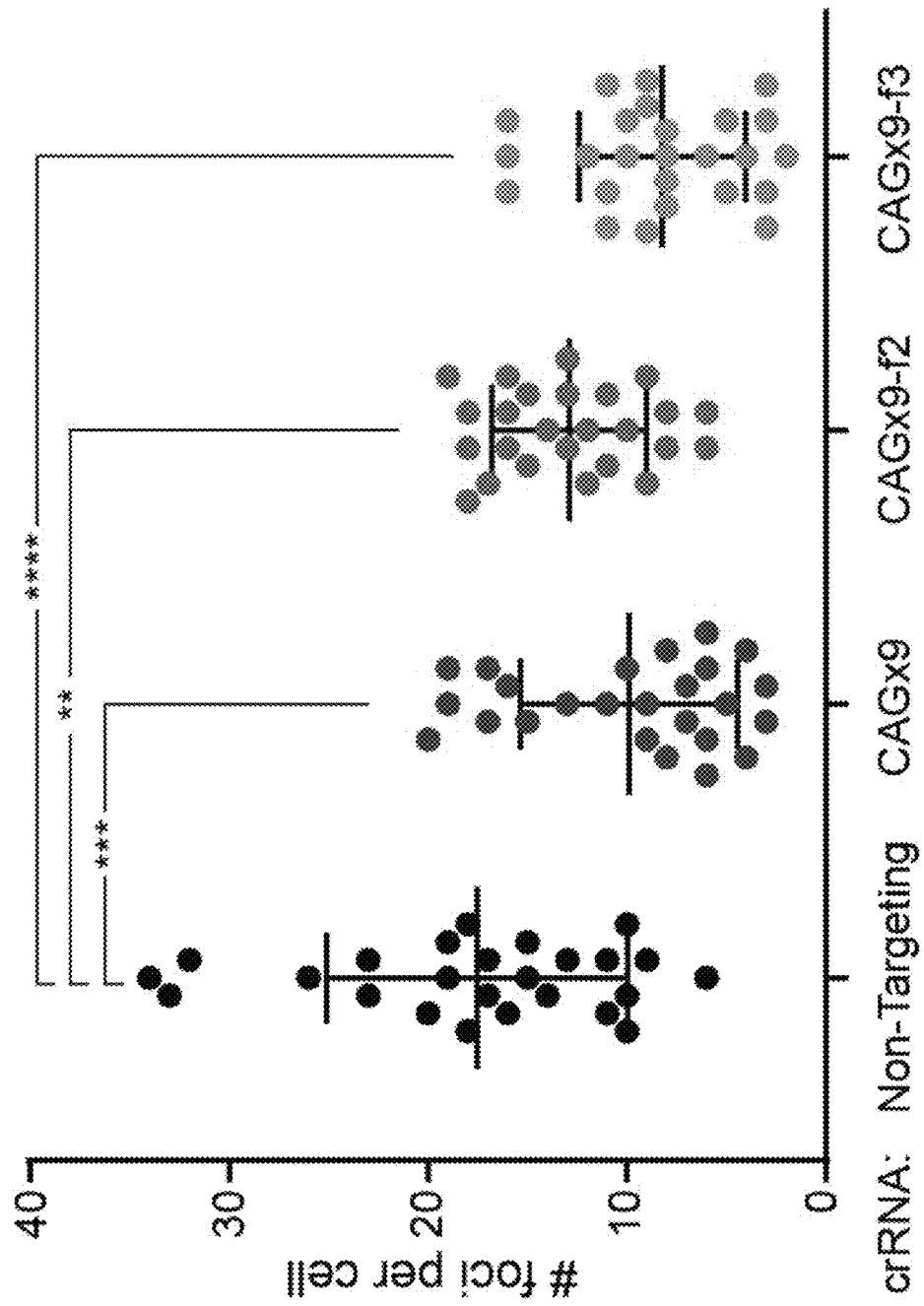
Figure 24:
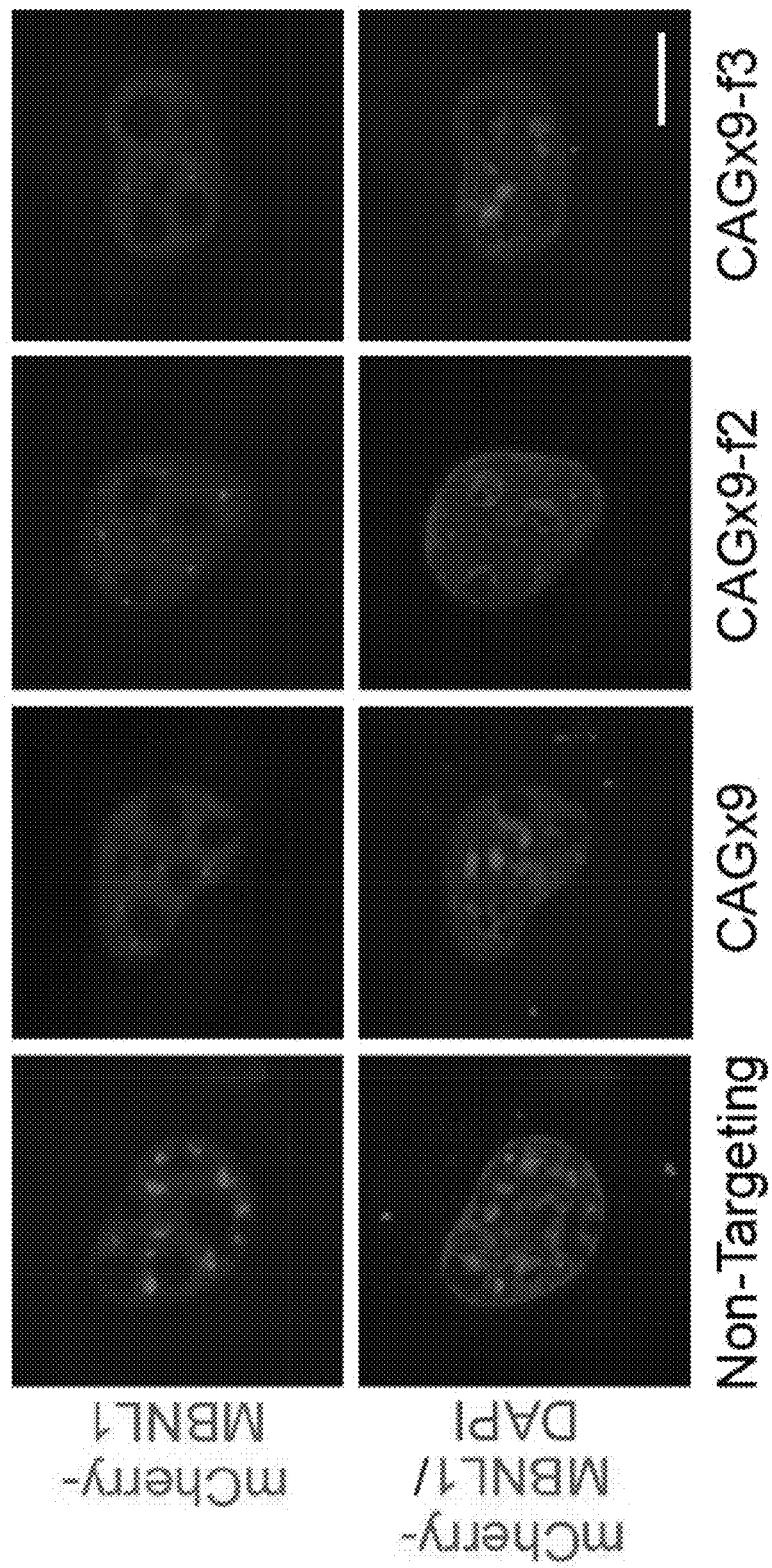
FIG. 24, comprising
Figure 27:
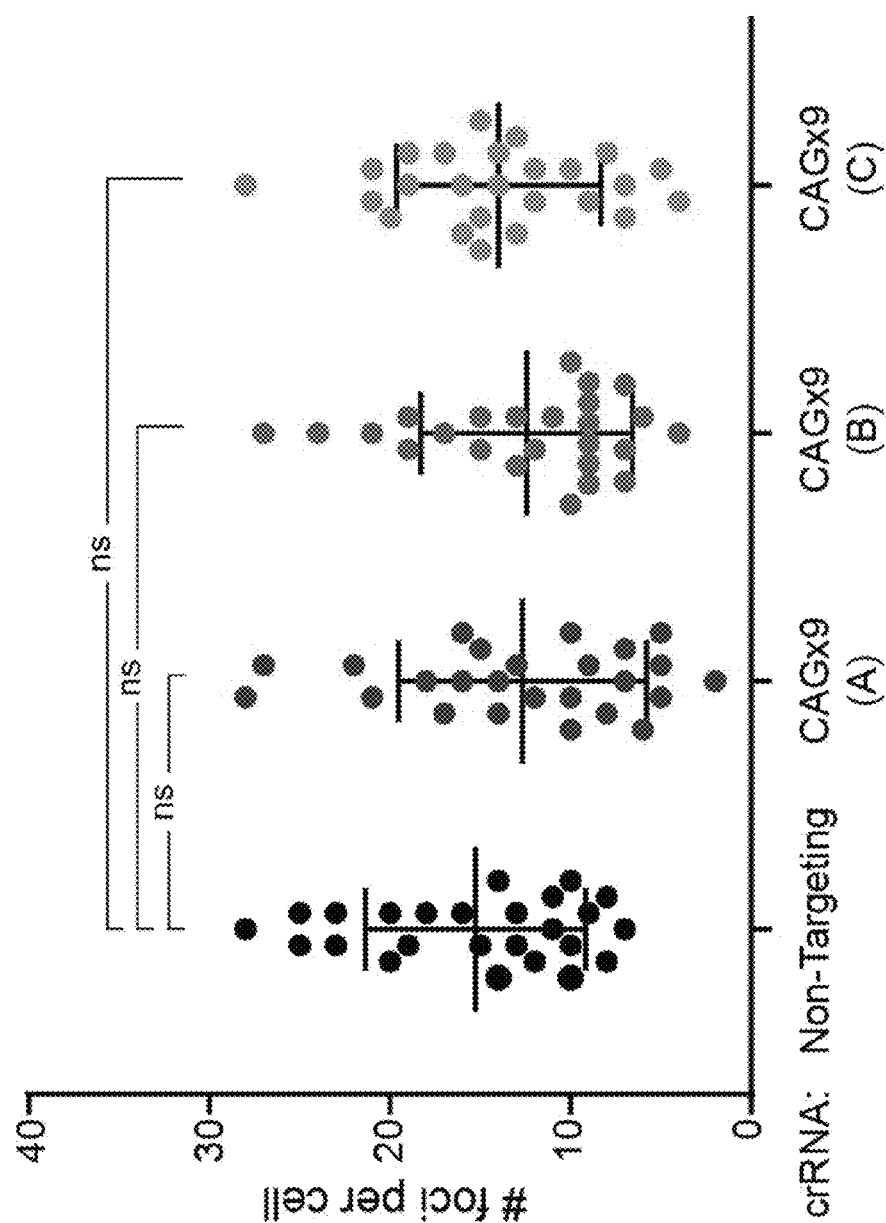
FIG. 27 depicts experimental results demonstrating catalytically dead Cas13 (dCas13) does not significantly reduce the number of $CUG^{exp}$ RNA foci. Expression of dPspCas13b targeted with CAGx9 crRNAs does not significantly reduce the number of $CUG^{exp}$ RNA foci per cell, as detected by mCherry-MBNL1. ns—not significant.

$CUG^{exp}$ RNA foci suggested it could be a useful for targeted cleavage of toxic $CUG^{exp}$ RNA, using its inherent endoribonuclease activity. Cas13 has been shown to be useful for specific cleavage of mRNA transcripts in mammalian and plant cells. To determine if Cas13 endoribonuclease activity is sufficient to cleave $CUG^{exp}$ RNA foci, the hilightR green fusion protein was modified by reactivating PspCas13b's catalytic mutations using site directed mutagenesis. Surprisingly, activated hilightR green did not significantly reduce the number of RNA foci using the CAGx9 targeting crRNA, compared with a non-targeting guide-RNA. However, activated PspCas13b containing the N-terminal Ty1 NLS, but lacking the C-terminal eGFP (herein referred to as eraseR), resulted in a significant reduction in the number and intensity of RNA foci, quantified using an mCherry-MNBL1 fusion protein (FIGS. 24A and 24B). Since target site flanking sequences can influence Cas13 nuclease activation, CAGx9 crRNAs were tested in two other reading frames (CAGx9-f2 and CAGx9-f3). EraseR guided by all three CAGx9 crRNAs resulted in significant reduction in the number and intensity of RNA foci per cell, compared to a non-targeting crRNA (FIGS. 24A and 24B). Additionally, catalytically dead PspCas13b containing an N-terminal Ty1 NLS and lacking the C-terminal eGFP did not significantly reduce the number and intensity of RNA foci, quantified using an mCherry-MNBL1 fusion protein (FIG. 27). These date demonstrate for the first time that CRISPR-Cas13 is sufficient to degrade CUG$^{exp}$ RNA foci.

While there are currently no available therapeutic treatments for Myotonic Dystrophies or other human RNA repeat expansion disorders, the rapid progression of RNA-targeting CRISPR-Cas systems offer hope that targeted approaches to treat DM1 will soon be achievable. While ASOs are highly efficient for disrupting the binding between splicing factors and toxic RNA foci, these approaches are currently limited by inadequate delivery methods. Additionally, gene therapy approaches to restore DMPK or MBNL expression are insufficient to rescue the dominant cytotoxic gain of function deficits which occur as the result of CUG$^{exp}$ RNAs. Thus, targeted disruption of CUG RNAs is a promising strategy to reduce or prevent RNA induced disease. It is demonstrated herein that CRISPR-Cas13, localized by a powerful non-classical Ty1 NLS, can be used to efficiently target CUG$^{exp}$ RNA foci for both visualization and targeted degradation. The Ty1 NLS is derived from a yeast LTR-retrotransposon, which uses reverse transcription of an RNA intermediate in the cytoplasm followed by integration of a proviral DNA copy in the nucleus for genome replication. As opposed to higher eukaryotes which undergo open mitosis during cell division, yeast undergo closed mitosis, during which the nuclear envelope remains intact. During Ty1 biogenesis, nuclear import of the retrotransposon genome complex requires active nuclear import and thus contains a robust NLS which is required for retrotransposition. Interestingly, in the quiescent mammalian cells which retain a nuclear envelope, the Ty1 NLS may be similarly required for efficient targeting of nuclear RNAs by Cas proteins.

The programmable nature of CRISPR-Cas13, through simple modification of crRNA target sequences, allow hilightR and eraseR to be easily adapted for the study and cleavage of other nuclear RNAs, or other repeat expansion disorders such as Myotonic Dystrophy type 2 (DM2), Amyotrophic lateral sclerosis (ALS), Huntington's disease-like 2 (HDL2), Spinocerebellar ataxias 8, 31 and 10 (SCAB, -31, -10) and fragile X-associated tremor ataxia syndrome (FXTAS). As with other systems (ASO or CRISPR-Cas) which directly target short tandem repeat sequences, there remains potential for off-target cleavage of other human mRNA transcripts which contain non-pathogenic short repeat motifs. Alternatively, targeting unique DMPK sequences for degradation or by other forms of RNA manipulation of microsatellite RNAs with CRISPR-Cas13 fusion proteins may offer additional approaches for the treatment of toxic RNA diseases.

The materials and methods are now described.
Synthetic DNA and Cloning

The mammalian expression vector containing an N-terminal 3×FLAG and Ty1 NLS fused to dPspCas13b was modified to encode a C-terminal enhanced Green Fluorescent Protein (eGFP) or mCherry red fluorescent protein. All crRNAs were designed to be 30 nucleotides in length and start with a 5' G for efficient transcription from the hU6 promoter in pC00043. The negative control non-targeting crRNA has been previous described. To generate the mCherry-MBNL expression plasmid, the coding sequence of human MBNL1 was designed and synthesized for assembly as a gBlock (IDT, Integrated DNA Technologies) and cloned into the CS2mCherry mammalian expression plasmid.
Cell Culture and Immunohistochemistry The COS7 cell line was maintained in DMEM supplemented with 10% Fetal Bovine Serum (FBS) with penicillin/streptomycin at 37° C. in an atmosphere of 5% CO$_2$. Cells were seeded on glass coverslips in 6-well plates and transiently transfected using Fugene6 (Promega) according to manufacturer's protocol. Transiently transfected COS7 cells were fixed in 4% formaldehyde in DPBS for 15 minutes, blocked in 3% Bovine Serum Albumin (BSA) and incubated with primary antibodies in 1% BSA for 4 hours at room temperature. Primary antibodies used were anti-FLAG (Sigma, F1864) at 1:1000 and anti-SC-35 (Abcam, ab11826) at 1:1000. Cells were subsequently incubated with an Alexa Fluor 488 or 594 conjugated secondary antibody (Thermofisher) in 1% BSA for 30 minutes at room temperature. Coverslips were mounted using anti-fade fluorescent mounting medium containing DAPI (Vector Biolabs, H-1200) and imaged using confocal microscopy.
Fluorescent In Situ Hybridization (FISH)

Post-transfection, cells were fixed in ice cold 100% Methanol for 10 minutes at −20° C., then washed 2 times with DPBS and 1 time with Wash Buffer [2×SSC pH 7.0, 10% Formamide]. Cells were subsequently hybridized with probe in Hybridization Buffer [10% Dextran Sulfate, 2×SSC pH7.0, 10% Formamide] with a final probe concentration of 100 nM. Cells were hybridized overnight at 37° C. Cells were then washed one time in Wash Buffer at 37° C. for 30 minutes, then mounted with VectaShield with DAPI (Vector Biolabs) on slides and imaged using confocal microscopy. The probe was a 21-mer DNA oligonucleotide (CAGCAGCAGCAGCAGCAGCAG (SEQ ID NO:762)) conjugated with a 5' Alexa Fluor 488 dye and purified using HPLC (IDT, Integrated DNA Technologies).

Example 7: Targeted Degradation of CUGexp RNA with Eraser

Figure 29:
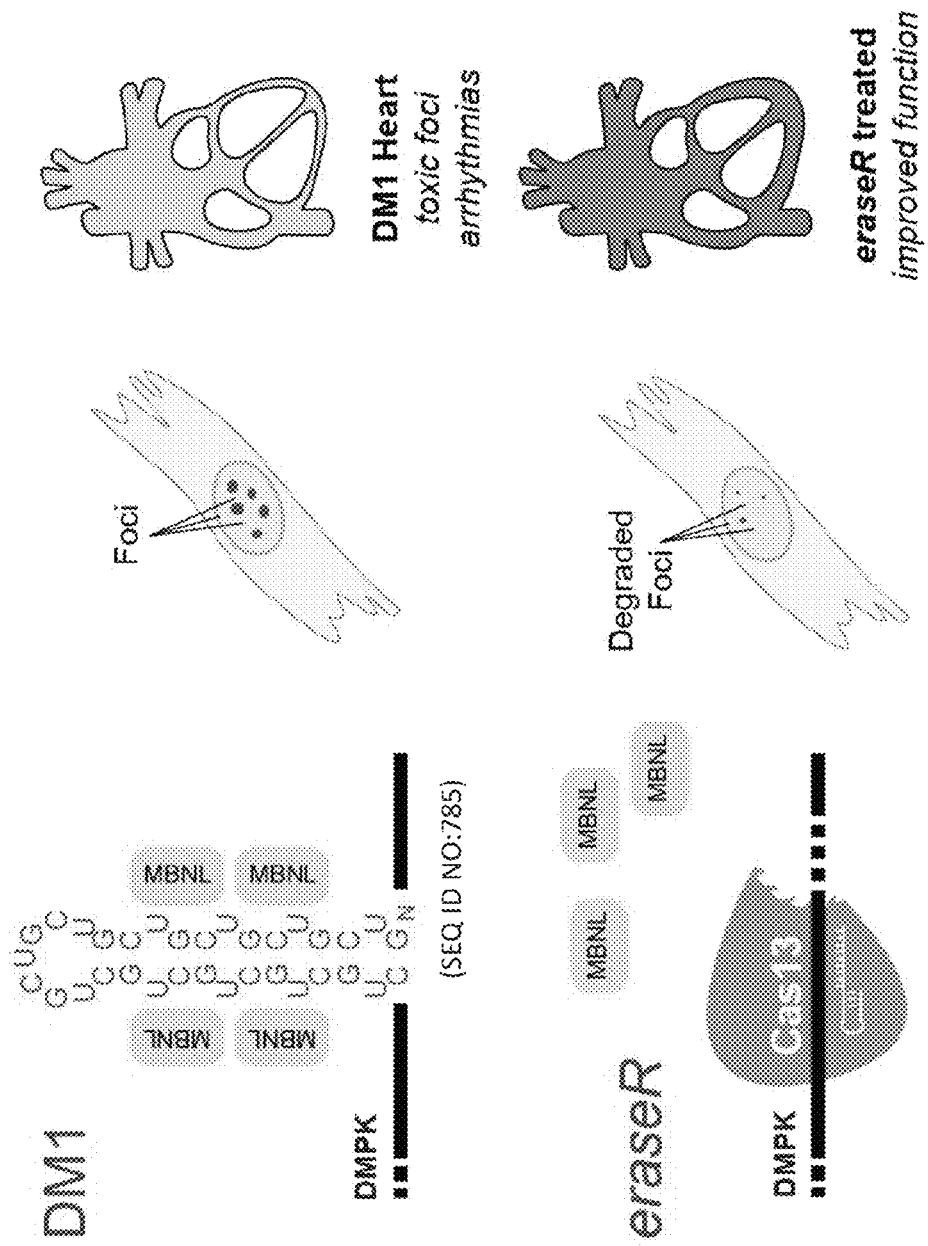
FIG. 29 depicts a schematic showing myotonic dystrophy type 1 (DM1) is an inherited multi-system, progressively debilitating disease occurring in 1 in 8,000 individuals, with an incidence as high as 1 in 500 in specific populations Cardiac complications develop in ~80% of DM1 patients and is the primary cause of death. DM1 arises from the expansion and expression of a CUG trinucleotide repeat in the noncoding 3' untranslated region of the human Dystrophia myotonica protein kinase (DMPK) gene. Mutant DMPK mRNAs with greater than ~50 CUG repeats form toxic nuclear RNA foci, which prevent normal DMPK expression and induce widespread defects in alternative splicing by sequestering members of the muscleblind-like (MBNL) family of RNA binding proteins. Due to the multitude of disrupted muscle genes underlying DM1 pathogenesis, patients often present with a variety of clinical cardiac phenotypes, including atrial and ventricular arrhythmias, dilated cardiomyopathy, and myocardial fibrosis. RNA binding CRISPR-Cas13, when localized with a robust non-classical nuclear localization signal (hilightR and eraseR), can be used to visualize and degrade toxic nuclear RNA foci in cells.

Myotonic dystrophy type 1 (DM1) is an inherited multisystem, progressively debilitating disease occurring in 1 in 8,000 individuals, with an incidence as high as 1 in 500 in specific populations Cardiac complications develop in ~80% of DM1 patients and is the primary cause of death. DM1 arises from the expansion and expression of a CUG trinucleotide repeat in the noncoding 3' untranslated region of the human Dystrophia myotonica protein kinase (DMPK) gene (FIG. 29). Mutant DMPK mRNAs with greater than ~50 CUG repeats form toxic nuclear RNA foci, which prevent normal DMPK expression and induce widespread defects in alternative splicing by sequestering members of the muscleblind-like (MBNL) family of RNA binding proteins (FIG. 29). Due to the multitude of disrupted muscle genes underlying DM1 pathogenesis, patients often present with a variety of clinical cardiac phenotypes, including atrial and ventricular arrhythmias, dilated cardiomyopathy, and myocardial fibrosis. There are currently no approved therapies to treat DM1, and previous approaches to target repeat foci using anti-sense oligonucleotides (ASOs) remain challenging due to inefficient delivery to adult human cardiac and skeletal muscle.

As demonstrated in Example 6 that RNA binding CRISPR-Cas13, when localized with a robust non-classical nuclear localization signal, can be used to visualize and degrade toxic nuclear RNA foci in cells, tools named hilightR and eraseR (FIG. 29). CRISPR-Cas technologies offer hope that targeted therapeutics can be developed for treatment of human RNA diseases, which cannot be corrected using traditional gene therapy replacement strategies. However, it remains unclear if degradation of toxic RNA foci is sufficient to prevent DM1 pathogenesis in the heart or if DM1-associated cellular and electrical remodeling is reversible. Targeted degradation of toxic RNA foci with eraseR in a mouse cardiac model of DM1 improves cardiac gene expression and pump function by restoring normal RNA splicing (FIG. 29). As described herein eraseR is developed as an efficient and specific tool for disrupting CUG$^{exp}$ RNA in vivo and determine the therapeutic outcomes using eraseR in a mouse cardiac model of DM1.

Toxic Nuclear Foci can be Targeted by Cas13

CRISPR-Cas13 systems bind only to RNA and function as specific endoribonucleases to cleave target RNAs, bypassing the risk of germline editing that is associated with DNA-binding CRISPR-Cas endonucleases. However, due to their large size and lack of intrinsic localization signals, Cas13 fusion proteins are inefficiently localized to the mammalian nucleus. We recently identified a non-classical nuclear localization signal (NLS) derived from the yeast Ty1 retrotransposon which promotes robust nuclear localization of Cas13. The powerful activity of the Ty1 NLS suggested that efficient targeting of nuclear RNAs could be achieved for either visualization or cleavage using CRISPR-Cas13.

To determine nuclear repeat RNAs could be visualized in live cells, a fusion protein was designed using the catalytically dead Type VI-B Cas13b enzyme from *Prevotella* sp. P5-125 (dPspCas13b) with a C-terminal enhanced Green Fluorescent Protein (eGFP) (FIG. 22A). To mimic the nuclear RNA foci found in patients with DM1, transient expression of a vector containing 960 CUG repeats in the human DMPK 3' UTR (DT960) was used (FIG. 22B). To target the dPspCas13b-eGFP fusion protein to CUG repeats, a PspCas13b compatible crRNA containing a CAG repeat target sequence was designed, which is predicted to hybridize with 9 CUG repeats (FIG. 22C). Guided by the CAG repeat crRNA, co-transfection of the dPspCas13b-eGFP was completely nuclear localized and highlighted nuclear RNA foci generated specifically from the expression of DT960 (FIG. 22D). In contrast, co-expression with a non-targeting crRNA resulted in broad, un-localized nuclear fluorescence (FIG. 22D). The efficient nuclear targeting of Cas13 to CUG RNA foci suggested it could be a useful tool for targeted cleavage of $CUG^{exp}$ RNA using its inherent endoribonuclease activity.

EraseR can Degrade Toxic RNA Foci In Vitro

Activated PspCas13b, containing the Ty1 NLS, resulted in a significant reduction in the number of RNA foci and intensity, as detected using mCherry-MNBL1 (FIGS. 24A and 24B). Because surrounding target sequences can influence Cas13 nuclease activity, crRNAs were tested in all three reading frames and all CAGx9 crRNAs resulted in significant reduction in the number of RNA foci per cell (FIG. 24). These data show that eraseR efficiently reduces toxic RNA foci induced by $CUG^{exp}$ in the human DMPK gene in vitro.

These studies are the first to demonstrate that CRISPR-Cas13 are sufficient to target and degrade $CUG^{exp}$ RNA, which offers a clear path towards the development of novel therapeutic approaches for treating DM1. Additional studies are rigorously designed and controlled to determine the parameters which enhance eraseR cleavage of toxic RNA foci and efficacy in a cardiac humanized mouse model of DM1. Importantly, the tools developed and tested herein are identical to those which could be delivered to human DM1 patients.

Targeted Degradation of $CUG^{exp}$ RNA with eraseR

Multiple variables can impact the cleavage efficiency of CRISPR-Cas13 endoribonuclease activation, which ultimately will underscore the efficiency of cleavage and therapeutic potential of eraseR for treating DM1. While the data presented herein showed that eraseR can already significantly degrade RNA foci, it is determined herein if cleavage efficiency can be further enhanced by modifications to the Cas13 protein, crRNA guide and/or target sequences. Reduction of RNA foci in cells is analyzed using fluorescent in situ hybridization (FISH), fluorescence using an mCherry-tagged MBNL1, and quantitative realtime-PCR using primers specific to the DT960 transcript.

Different Cas13 family members. EraseR utilizes Cas13b from *Prevotella* sp. P5-125 (PspCas13b), which was previously shown to be the most robust Cas13 member for RNA base editing. However, Cas13 systems are comprised by 4 major families (Cas13A-D), which may provide different cleavage activities for degrading $CUG^{exp}$ RNA foci. Therefore, representative Cas13 proteins are cloned with N terminal Ty1 NLS fusions into the CSX expression vector and their relative cleavage efficiencies are determined compared to PspCas13b.

Guide RNA length. Every naturally occurring Cas13 CRISPR array has a specific spacer and direct repeat length, with the spacer length corresponding to the size of the RNA target sequence. Initial studies with PspCas13 utilized a spacer length of 30 nucleotides, which matches the endogenous spacer size. However, spacer length can influence target sequence recognition, cleavage activation, or packing of Cas13 enzymes onto tandem repeat sequences. Therefore, it is tested whether spacer length influences degradation of foci by testing crRNAs with shorter (25 nt), and longer (35, 40, 45, 50, 55 and 60 nts) in length.

Activation by CRISPR cleavage activity by Accessory Proteins. Some CRISPR-Cas13 families are clustered with smaller CRISPR associated proteins, which serve to either inhibit or enhance cleavage efficiency. It is determined if co-expression of Csx28, which has been previously shown to enhance Cas13b cleavage activity, enhances the degradation of RNA foci using our cell based assays.

Determination of Whether Reduction of RNA Foci by eraseR Ameliorates DM1 Cardiovascular Phenotypes In Vivo.

A cardiac DM1 mouse model with a Tet inducible transgene encoding the human DMPK gene with 960 CUG repeats (CUG960) is used and is induced using a cardiac specific tTA transgene (Myh6-tTA) (FIG. 30). Expression of this construct has previously been shown to induce MBNL-associated RNA foci formation, splicing defects, and cardiac dysfunction, including dilated cardiomyopathy, arrhythmias and contractile defects. Briefly, CUG960 homozygous mice are crossed with a hemizygous tTA mouse to generate bi-transgenic offspring (CUG960 and Myh6-tTA) and single transgenic (CUG960) controls (FIG. 30A and FIG. 30B).

Cardiomyocyte-specific gene delivery using AAV9 virus in mice. AAV9 serotype virus is a promising therapeutic vector for delivery and expression of genes in the heart. EraseR and guide-RNA expression cassettes are subcloned into an AAV9 viral packaging plasmid and high titer virus is generated (FIG. 30C). For these studies, eraseR using the PspCas13b and CAGx9 guide RNA is used. AAV9 virus encoding Luciferase driven by the chicken cardiac Troponin T promoter (cTnT) for cardiomyocyte-specific expression (pAAV:cTNT::Luciferase), showed robust cardiac specific expression, when injected intraperitoneally in postnatal day 10 (P10) neonates and visualized using 150 μg/g Luciferin after 10 weeks (FIG. 30D). At P10, 3.75e11 gc/ml of AAV is injected via the superficial temporal vein in 6 male and 6 female CUG960:tTA bi-transgenic mice, and an equal number of male and female single transgenic controls. Measurements (see below) are made at 12 weeks post injection. EraseR treated mice show improved cardiac function (FIG. 30E).

Determination of whether eraseR treatment ameliorates heart function by echocardiography and electrocardiography. Serial echocardiography are performed at 12 weeks following AAV-mediated eraseR injection by two-dimensional echocardiography using the SIG Visual Sonics Vevo 2100. Measurements of heart rate (HR), fractional shortening (FS) and ejection fraction (EF), and left ventricular dimensions are recorded and compared. Fractional shortening (% FS) are used to indicate impaired cardiac function and a % FS below 40% is used to indicate cardiomyopathy. ECG measurements on anesthetized mice are measured using AdInstruments BioAmp ECG apparatus. ECG recordings are captured for 10 minutes for each animal and analyzed using LabChart7 software. Special attention is paid to the lengths of the PR and QRS intervals, as this is prolonged in DM1.

Evaluation of cardiac histology and RNA foci in EraseR-treated DM1 hearts. Following echocardiography and ECG measurements, hearts are collected for histological analysis for by paraffin embedding. H&E staining is used to visualize any differences in gross anatomy and cardiomyocyte cell morphology. To identify changes in heart growth, morphometric measurements include heart weight to body weight, heart weight to tibia length, left ventricular posterior wall thickness and interventricular septum thickness. At 12 weeks of age, after non-invasive cardiac monitoring experiments are performed, hearts from half the mice are harvested for histology and half the hearts are analyzed using qRT-PCR to determine knockdown of the CUG960 transgene and for rescue of splicing. Nuclear foci is examined at 12 weeks by FISH using a 21-mer oligonucleotide conjugated with a 5' Alexa Fluor 488 dye. Nuclei are counterstained with DAPI. EraseR treated mice have significantly reduced nuclear foci and decreased levels of toxic RNA.

Models which have been developed for DM1 can vary broadly in their phenotypic severity and gender specific differences may interfere with outcomes of heart phenotype and cardiac electrophysiology. Male DM1 patients are more likely to present with DM1 symptoms and more at risk for developing cardiac conduction defects than female patients. Given the importance of gender specific differences, both genders are examined.

Statistical Methods. Students t-test is applied to compare single treatments. Multiple physiological and biochemical assays are analyzed using one-way or repeated measures ANOVA. Post-hoc analysis (i.e. Newman-Keuls) is performed.

Example 7: Postscriptr-Mediated Activation of Calcineurin Signaling

Calcineurin is a highly conserved, $Ca^{2+}$/calmodulin-dependent protein phosphatase which plays an important role in the intracellular signaling pathways important for many biological processes, including growth and stimulation of T cells, lung maturation and stress-induced pathological cardiac hypertrophy. Calcineurin functions as a heterodimer consisting of a catalytic subunit (Calcineurin A, CnA) and regulatory subunit (Calcineurin B, CnB). The catalytic subunit contains a C-terminal auto-inhibitory domain, which in the absence of calcium signaling, inhibits Calcineurin activity (FIG. 31A). Upon activation by $Ca^{2+}$/calmodulin binding, which relieves autoinhibition, Calcineurin dephophorylates NFAT transcription factors, which allow for their entry into the nucleus and activation of NFAT-dependent gene programs (FIG. 31B). Previous data have shown that expression of Calcineurin lacking the C-terminal auto inhibitory domain allows for constitutive activation and nuclear important of NFAT transcription factors, which can be visualized using an NFAT-GFP fluorescent reporter. To determine if Postscriptr could be utilized to induce the expression of a C-terminal Calcineurin protein lacking its autoinhibitory domain, a Cas13b crRNA targeting an intron sequence of mouse Calcineurin catalytic subunit (PPP3CB) was designed (FIG. 31C). While expression of Postscriptr guided with a non-targeting crRNA did not alter the localization of an NFAT-GFP reporter, which is primarily localized to the cytoplasm, a crRNA targeting the PPPCB gene resulted in robust nuclear localization of the NFAT-GFP reporter, suggesting activation of Calcineurin activity in these cells (FIG. 31D).

Example 8: Enhancing RNA Visualization and Fusion Protein Localization with dCas13

Fusion of dPspCas13b with enhanced GFP (eGFP), combined with the Ty1 NLS, allowed for robust and specific visualization of nuclear RNA foci (FIG. 32A). For visualization of microsatellite repeat expanded RNA foci, target RNA signal intensity over background is aided by 1) multiple RNA target sequences within the repetitive RNA sequences, and 2) focal concentration of signal within a nuclear foci. Visualization applications targeting unique or low copy RNA sequences are traditionally hampered by low signal-to-noise ratios. Described herein is an approach for Cas13 to enhance the 1) signal to noise ratio of dCas13 targeted RNAs or to increase the localization of a fusion protein to a target RNA sequence.

This approach relies on the fluorescent complementation inherent in superfolder GFP, which similar to GFP, is comprised of a beta barrel structure of 11 beta strands. Deletion of the $11^{th}$ beta strand from sfGFP abolishes fluorescent activity, however, the $11^{th}$ beta strand can be delivered in cis or trans to restore fluorescence. Further, the $11^{th}$ strand can serve as a small tag on a protein, which when co-expressed with sfGFP encoding the first 10 beta strands, will reconstitute a GFP fusion protein (FIG. 32B). Tandem assembly of S11 strands has the potential to increase the signal to noise ratio of dCas13 targeted RNAs (FIG. 32C). Further, this approach could be similarly useful for targeting a larger number of fusion proteins (Protein X) when co-expressed with a sfGFP 1-10 encoding a fusion to a protein of interest (FIG. 32D).

Figures 33, 33C:
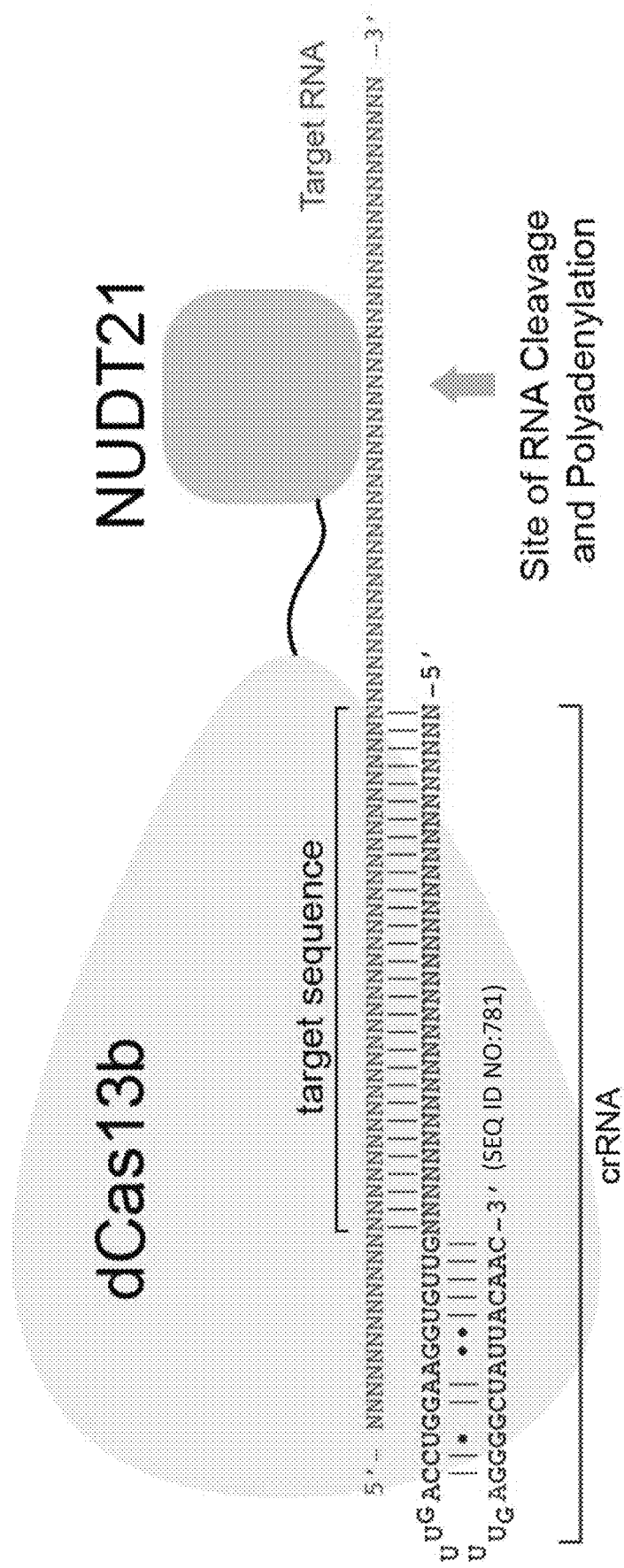

Example 9: Structure-Function Analysis of Structure-Function Analysis of Postscriptr-Mediated RNA Cleavage and Polyadenylation FIG. 33 demonstrates a structure-function analysis of Postscriptr RNA editing. The crystal structures of Cas13b (PDB: 6DTD) (Slaymaker et al., Cell Rep, 2019, 26: 3741-3751 e5) and NUDT21 (PDB: 3MDG) (Yang et al., PNAS, 2010, 107:10062-7) were used to model the dCas13b-NUDT21 fusion protein and crRNA (FIG. 33A). NUDT21 forms a natural homodimer, which due to the close proximity of N and C-termini, can be expressed as a tandem dimer fused to dCas13b (dCas13b-tdNUDT21) (FIG. 33B). The orientation of NUDT21 is predicted to occur 3' to the crRNA target sequence on the Target RNA, which is consistent with the observed location of Postscriptr-induced RNA cleavage and polyadenylation. (FIG. 33C).

The disclosures of each and every patent, patent application, and publication cited herein are hereby incorporated herein by reference in their entirety.

While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

SEQUENCE LISTING (789 sequences)

SEQ ID NO: 1 - protein, 1089 aa, Artificial Sequence
  Chemically synthesized
NIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 2 - protein, 982 aa, Artificial Sequence
  Chemically synthesized
NIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKED

SEQ ID NO: 3 - protein, 953 aa, Artificial Sequence
  Chemically synthesized
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 4 - protein, 1111 aa, Artificial Sequence
  Chemically synthesized
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 5 - protein, 1276 aa, Artificial Sequence
  Chemically synthesized
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 6 - protein, 1224 aa, Artificial Sequence
  Chemically synthesized
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 7 - protein, 1385 aa, Artificial Sequence
  Chemically synthesized
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 8 - protein, 1199 aa, Artificial Sequence
  Chemically synthesized
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 9 - protein, 1164 aa, Artificial Sequence
  Chemically synthesized
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 10 - protein, 1175 aa, Artificial Sequence
  Chemically synthesized
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 11 - protein, 1373 aa, Artificial Sequence
  Chemically synthesized
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 12 - protein, 1344 aa, Artificial Sequence
  Chemically synthesized
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 13 - protein, 954 aa, Artificial Sequence
  Chemically synthesized
MGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLRHWCVHSEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFRNTVCHLNAIRNININIKEIKEVENYFALYHYLIQKHLENRFADKKVERDTGDFISKLEEHKTYCKDFVKAYCTPFGYNLVRYKNLTIDGLFDKNYPGKDDSDEQK

SEQ ID NO: 14 - protein, 1150 aa, Artificial Sequence
  Chemically synthesized
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 15 - protein, 1110 aa, Artificial Sequence
  Chemically synthesized
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 16 - protein, 1111 aa, Artificial Sequence
  Chemically synthesized
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 17 - protein, 668 aa, Artificial Sequence
  Chemically synthesized
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 18 - protein, 1115 aa, Artificial Sequence
  Chemically synthesized
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 19 - protein, 1121 aa, Artificial Sequence
  Chemically synthesized
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 20 - protein, 897 aa, Artificial Sequence
  Chemically synthesized
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 21 - protein, 1285 aa, Artificial Sequence
  Chemically synthesized
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 22 - protein, 1051 aa, Artificial Sequence
  Chemically synthesized
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 23 - protein, 1340 aa, Artificial Sequence
  Chemically synthesized
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 24 - protein, 1437 aa, Artificial Sequence
  Chemically synthesized
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 25 - protein, 1159 aa, Artificial Sequence
  Chemically synthesized
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 26 - protein, 1120 aa, Artificial Sequence
  Chemically synthesized
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 27 - protein, 1389 aa, Artificial Sequence
  Chemically synthesized
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 28 - protein, 1385 aa, Artificial Sequence
  Chemically synthesized
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 29 - protein, 1152 aa, Artificial Sequence
  Chemically synthesized
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 30 - protein, 1152 aa, Artificial Sequence; identical to SEQ ID NO: 29
  Chemically synthesized

SEQ ID NO: 31 - protein, 970 aa, Artificial Sequence
  Chemically synthesized
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 32 - protein, 1124 aa, Artificial Sequence
  Chemically synthesized
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 33 - protein, 1127 aa, Artificial Sequence
  Chemically synthesized
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 34 - protein, 1119 aa, Artificial Sequence
  Chemically synthesized
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 35 - protein, 1175 aa, Artificial Sequence
  Chemically synthesized
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 36 - protein, 1120 aa, Artificial Sequence
  Chemically synthesized
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 37 - protein, 1132 aa, Artificial Sequence
  Chemically synthesized
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 38 - protein, 1126 aa, Artificial Sequence
  Chemically synthesized
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 39 - protein, 1154 aa, Artificial Sequence
  Chemically synthesized
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 40 - protein, 1151 aa, Artificial Sequence
  Chemically synthesized
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 41 - protein, 1322 aa, Artificial Sequence
  Chemically synthesized
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 42 - protein, 1095 aa, Artificial Sequence
  Chemically synthesized
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 43 - protein, 1285 aa, Artificial Sequence
  Chemically synthesized
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 44 - protein, 1285 aa, Artificial Sequence; identical to SEQ ID NO: 43
  Chemically synthesized

SEQ ID NO: 45 - protein, 1285 aa, Artificial Sequence
  Chemically synthesized
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 46 - protein, 922 aa, Artificial Sequence
  Chemically synthesized
MAKKNKMKPRELREAQKKARQLKAAEINNNAAPAIAAMPAAEVIAPVAEKKKSSVKAAGMKSILVSENKMYITSFGKGNSAVLEYEVDNNDYNKTQLSSKDNSNIELGDVNEVNITFSSKHGFGSGVEINTSNPTHRSGESSPVRGDMLGLKSELEKRFFGKTFDDNIHIQLIYNILDIEKILAVYVTNIVYALNNMLGIKDSESYDDFMGYLSARNTYEVFTHPDKSNLSDKVKGNIKKSLSKFNDLLKTKRLGYFGLEEPKTKDTRASEAYKKRVYHMLAIVGQIRQCVFHDKSGAKRFDLYSFINNIDPEYRDTLDYLVEERLKSINKDFIEGNKVNISLLIDMMKGYEADDIIRLYYDFIVLKSQKNLGFSIKKLREKMLEEYGFRFKDKQYDSVRSKMYKLMDFLLFCNYYRNDVAAGEALVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDNITDDRISEILKLKEKGKGIHGLRNFITNNVIESSRFVYLIKYANAQKIREVAKNEKVVMFVLGGIPDTQIERYYKSCVEFPDMNSSLEAKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDDRNESSNLFLKKNKRLRKCVEVDINNADSSMTRKYRNCIAHLTVVRELKEYIGDIRTVDSYFSIYHYVMQRCITKRGDDTKQEEKIKYEDDLLKNHGYTKDFVKALNSPFGYNIPRFKNLSIEQLFDRNEYLTEK

SEQ ID NO: 47 - protein, 1089 aa, Artificial Sequence
  Chemically synthesized
NIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDANNYPDKGVVEIKALPEIAMSIKKAFGEYAIMK

SEQ ID NO: 48 - protein, 982 aa, Artificial Sequence
  Chemically synthesized
NIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKED

SEQ ID NO: 49 - protein, 243 aa, Artificial Sequence
  Chemically synthesized
QEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQRTPQVIGVMQSQNSSAGNRGPRPLEQVTCYKCGEKGHYANRCTKGHLAFLSGQ

SEQ ID NO: 50 - protein, 567 aa, Artificial Sequence
  Chemically synthesized
GSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRGHGADVKCVDWHPTKGLVVSGSKDSQQPIKFWDPKTGQSLATLHAHKNTVMEVKLNLNGNWLLTASRDHLCKLFDIRNLKEELQVFRGHKKEATAVAWHPVHEGLFASGGSDGSLLFWHVGVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQI

SEQ ID NO: 51 - protein, 226 aa, Artificial Sequence
  Chemically synthesized
SVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 52 - protein, 227 aa, Artificial Sequence
  Chemically synthesized
MEDIWPTIERTTISASVPEAPANFDEKPPFNRTINVYPLTNYTFGTKDAQAEKDKSVPERFKRMKDEYEVMGMRRSVEAVLIVHEHSLPHILLLQIGTTFYKLPGGELELGEDEISGVTRLLNETLGRTDGETNEWTIEDEIGNWWRPNFDPPRYPYIPAHVTKPKEHTKLLLVQLPSKSTFCVPKNFKLVAAPLFELYDNAAAYGPLISSLPTTLSRFNFIFNDSN

SEQ ID NO: 53 - protein, 237 aa, Artificial Sequence
  Chemically synthesized
MASSQVSNKSGSGWPRRGSQGQADAASSNNNGTQKYTNQALTINRTINLYPLTNYTFGTKEPLFEKDPSVPSRFQRMREEFDRIGMRRSVEGVLLVHEHGLPHVLLLQLGTTFFKLPGGELNAGEDEVEGLKRLLSETLGRQDGVKQEWIVEDTIGNWWRPNFEPPQYPYIPPHITKPKEHKRLFLVQLHEKALFAVPKNYKLVAAPLFELYDNSQGYGPIISSLPQALCRFNFIYM

SEQ ID NO: 54 - protein, 228 aa, Artificial Sequence
  Chemically synthesized
MSVVPPNRSSTGWPRGVNQFGNKYITQATKPLTLERTINLYPLTNYTFGTKEPLYEKDSSVAARFQRMREEFEKIGMRRTVEGVLIVHEHRLPHVLLLQLGTTFFKLPGGELNPGEDEVEGLKRLMTEILGRQDGVKQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 55 - protein, 197 aa, Artificial Sequence
  Chemically synthesized
LTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 56 - protein, 226 aa, Artificial Sequence
  Chemically synthesized
SVVPPNRSQTGWPRGVTQFGNKYIQQTKPLTLERTINLYPLTNYTFGTKEPLYEKDSSVAASFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 57 - protein, 226 aa, Artificial Sequence
  Chemically synthesized
SVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTAFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 58 - protein, 462 aa, Artificial Sequence
  Chemically synthesized
SVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYNGGGGSGGGGSSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 59 - protein, 238 aa, Artificial Sequence
  Chemically synthesized
VSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 60 - protein, 236 aa, Artificial Sequence
  Chemically synthesized
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 61 - protein, 233 aa, Artificial Sequence
  Chemically synthesized
MEEDNMAIIKEFMRFKVHMEGSVNGHEFEIEGEGEGHPYEGTQTAKLKVTKGGPLPFAWDILSPQFMYGSKAYVKHPADIPDYLKLSFPEGFTWERVMNFEDGGVVTVTQDSSLQDGQFIYKVKLLGINFPSDGPVMQKKTMGWEASTERMYPEDGALKGEINQRLKLKDGGHYDAEVKTTYKAKKPVQLPGAYNVDIKLDITSHNEDRPDPENFRLLGNVLVIVLSHHFGKE

SEQ ID NO: 62 - protein, 238 aa, Artificial Sequence
  Chemically synthesized
MEEDNMAIIKEFMRFKVHMEGSVNGHEFEIEGEGEGHPYEGTQTAKLKVTKGGPLPFAWDILSPQFMYGSKAYVKHPADIPDYLKLSFPEGFTWERVMNFEDGGVVTVTQDSSLQDGQFIYKVKLLGINFPSDGPVMQKKTMGWEASTERMYPEDGALKGEINQRLKLKDGGHYDAEVKTTYKAKKPVQLPGAYNVDIKLDITSHNEDRPDPENFRVSLGTLYTIVEQYERAEARHST

SEQ ID NO: 63 - protein, 142 aa, Artificial Sequence
  Chemically synthesized
RDHMVLHEYVNAAGITGGSGGRDHMVLHEYVNAAGITGGSGGRDHMVLHEYVNAAGITGGSGGRDHMVLHEYVNAAGITGGSGGRDHMVLHEYVNAAGITGGSGGRDHMVLHEYVNAAGITGGSGGRDHMVLHEYVNAAGIT

SEQ ID NO: 64 - protein, 214 aa, Artificial Sequence
  Chemically synthesized
MSKGEELFTGVVPILVELDGDVNGHKFSVRGEGEGDATIGKLTLKFICTTGKLPVPWPTLVTTLTYGVQCFSRYPDHMKRHDFFKSAMPEGYVQERTISFKDDGKYKTRAVVKFEGDTLVNRIELKGTDFKEDGNILGHKLEYNFNSHNVYITADKQKNGIKANFTVRHNVEDGSVQLADHYQQNTPIGDGPVLLPDNHYLSTQTVLSKDPNEK

SEQ ID NO: 65 - protein, 239 aa, Artificial Sequence
  Chemically synthesized
MSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRPDPENFRLLGNVLVIVLSHHFGKE

SEQ ID NO: 66 - protein, 244 aa, Artificial Sequence
  Chemically synthesized
MSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRPDPENFRVSLGTLRDHMVLLEFVTAAGIT

SEQ ID NO: 67 - protein, 14 aa, Artificial Sequence
  Chemically synthesized
SRGGGGSGGGGSTR

SEQ ID NO: 68 - protein, 4 aa, Artificial Sequence
  Chemically synthesized
GGGG

SEQ ID NO: 69 - protein, 10 aa, Artificial Sequence
  Chemically synthesized
GGGGSGGGGS

SEQ ID NO: 70 - protein, 5 aa, Artificial Sequence
  Chemically synthesized
EAAAK

SEQ ID NO: 71 - protein, 10 aa, Artificial Sequence
  Chemically synthesized
EAAAKEAAAK

SEQ ID NO: 72 - protein, 12 aa, Artificial Sequence
  Chemically synthesized
KAEEEKKAAEEK

SEQ ID NO: 73 - protein, 16 aa, Artificial Sequence
  Chemically synthesized
SGSETPGTSESATPES

SEQ ID NO: 74 - protein, 22 aa, Artificial Sequence
  Chemically synthesized
DYKDHDGDYKDHDIDYKDDDDK

SEQ ID NO: 75 - protein, 39 aa, Artificial Sequence
  Chemically synthesized
NSKKRSLEDNETEIKVSRDTWNTKNMRSLEPPRSKKRIH

SEQ ID NO: 76 - protein, 39 aa, Artificial Sequence
  Chemically synthesized
KSKKRSLEDNETEIEVSRDTWNNKNMRSLEPPRSKKRIN

SEQ ID NO: 77 - protein, 43 aa, Artificial Sequence
  Chemically synthesized
TMKKRDAETADIGDQSEVESDTEELKKIMFGEKKKLNKKKRKQ

SEQ ID NO: 78 - protein, 9 aa, Artificial Sequence
  Chemically synthesized
PKKKRKVSS

SEQ ID NO: 79 - protein, 24 aa, Artificial Sequence
  Chemically synthesized
DPKKKRKVDPKKKRKVDPKKKRKV

SEQ ID NO: 80 - protein, 16 aa, Artificial Sequence
  Chemically synthesized
KRPAATKKAGQAKKKK

SEQ ID NO: 81 - protein, 37 aa, Artificial Sequence
  Chemically synthesized
RQKKRVYYDDGLTEEQFLEAVEDDNMSLEDAIKKRRE

SEQ ID NO: 82 - protein, 33 aa, Artificial Sequence
  Chemically synthesized
NVKKRKRRSKKINKLTDGQIRINHVSSEKKRRE

SEQ ID NO: 83 - protein, 34 aa, Artificial Sequence
  Chemically synthesized
KKRNSNEYRLVPTKWQDYKKPGPNQKYTSDGKKR

SEQ ID NO: 84 - protein, 36 aa, Artificial Sequence
  Chemically synthesized
KKRLHLIIADAELETVPPEILDHPAIVNYAKRRKKR

SEQ ID NO: 85 - protein, 29 aa, Artificial Sequence
  Chemically synthesized
KKRIEELEIELGLRAPPKKEKKGKKSKKR

SEQ ID NO: 86 - protein, 26 aa, Artificial Sequence
  Chemically synthesized
KKRALKYRLNPKLLKENNKKDVNKKR

SEQ ID NO: 87 - protein, 26 aa, Artificial Sequence
  Chemically synthesized
KKRNFLESIEISINLKDVDLSDPKKR

SEQ ID NO: 88 - protein, 30 aa, Artificial Sequence
  Chemically synthesized
KKRSEKSMALRLAGELSEAAEGRGGAMKKR

SEQ ID NO: 89 - protein, 30 aa, Artificial Sequence
  Chemically synthesized
KKRFKLTGTGKIKRKHAFKSHILTKKSKKR

SEQ ID NO: 90 - protein, 30 aa, Artificial Sequence
  Chemically synthesized
KKRNEHTMEERLAGELADAVNGRGTAVKKR

SEQ ID NO: 91 - protein, 30 aa, Artificial Sequence; identical to SEQ ID NO: 88
  Chemically synthesized

SEQ ID NO: 92 - protein, 30 aa, Artificial Sequence
  Chemically synthesized
KKRGEKSMSLRLANELMEATEGRGGAMKKR

SEQ ID NO: 93 - protein, 46 aa, Artificial Sequence
  Chemically synthesized
KKRLATHNAGKGAKYTRYRLPVSLLYYEVFDSKEAAMSAEALFKKR

SEQ ID NO: 94 - protein, 30 aa, Artificial Sequence; identical to SEQ ID NO: 88
  Chemically synthesized

SEQ ID NO: 95 - protein, 30 aa, Artificial Sequence; identical to SEQ ID NO: 88
  Chemically synthesized

SEQ ID NO: 96 - protein, 30 aa, Artificial Sequence; identical to SEQ ID NO: 88
  Chemically synthesized

SEQ ID NO: 97 - protein, 30 aa, Artificial Sequence; identical to SEQ ID NO: 88
  Chemically synthesized

SEQ ID NO: 98 - protein, 30 aa, Artificial Sequence; identical to SEQ ID NO: 88
  Chemically synthesized

SEQ ID NO: 99 - protein, 30 aa, Artificial Sequence
  Chemically synthesized
KKRGEKSMAQRLANELLEAAEGRGGAMKKR

SEQ ID NO: 100 - protein, 30 aa, Artificial Sequence
  Chemically synthesized
KKRFKVTGSGKIKRKHAFKSHILTKKSKKR

SEQ ID NO: 101 - protein, 44 aa, Artificial Sequence
  Chemically synthesized
KKRKKYLKAAKGYRGALSRRYKLAKQMYVRSKWYSYVGRKLKKR

SEQ ID NO: 102 - protein, 30 aa, Artificial Sequence; identical to SEQ ID NO: 100
  Chemically synthesized

SEQ ID NO: 103 - protein, 44 aa, Artificial Sequence
  Chemically synthesized
KKRKKIMKAVKGYRGALSRRYRLAKQAYIKAKKHAYVGRKLKKR

SEQ ID NO: 104 - protein, 32 aa, Artificial Sequence
  Chemically synthesized
KKRGYQTHGIRPRLAKKKTVMSKIARKQGKKR

SEQ ID NO: 105 - protein, 45 aa, Artificial Sequence
  Chemically synthesized
KKRREKFLKSAKGYRGAIKRRYRLAKQHYYRAKWYAYAGRKLKKR

SEQ ID NO: 106 - protein, 37 aa, Artificial Sequence
  Chemically synthesized
KKRIGLIFGGYSNEHEVSISSAKTVFQAFNSEINKKR

SEQ ID NO: 107 - protein, 30 aa, Artificial Sequence; identical to SEQ ID NO: 88
  Chemically synthesized

SEQ ID NO: 108 - protein, 30 aa, Artificial Sequence
  Chemically synthesized
KKRGEKSMDLRLAGELIDASEGRGAAMKKR

SEQ ID NO: 109 - protein, 46 aa, Artificial Sequence
  Chemically synthesized
KKRFSFHALHLRLSPRLLKSEKAQRHTKEYTARLYRAFMRSVEKKR

SEQ ID NO: 110 - protein, 30 aa, Artificial Sequence
  Chemically synthesized
KKRNEKTMEERLAKEILDASQGTGAAVKKR

SEQ ID NO: 111 - protein, 46 aa, Artificial Sequence
  Chemically synthesized
KKRAMELGIDVITPKNINDEEVFDLLDKLNPDFIVVVAYGQLIKKR

SEQ ID NO: 112 - protein, 30 aa, Artificial Sequence; identical to SEQ ID NO: 88
  Chemically synthesized

SEQ ID NO: 113 - protein, 44 aa, Artificial Sequence
  Chemically synthesized
KKRKKYLKAAKGYRGALSRRYKLAKQMYVRSKWYSYVGRKQKKR

SEQ ID NO: 114 - protein, 42 aa, Artificial Sequence
  Chemically synthesized
KKRRAILEAASGYRGQRSRLYRKAKEQVTHSLVYNYNDRKKR

SEQ ID NO: 115 - protein, 30 aa, Artificial Sequence; identical to SEQ ID NO: 99
  Chemically synthesized

SEQ ID NO: 116 - protein, 30 aa, Artificial Sequence; identical to SEQ ID NO: 88
  Chemically synthesized

SEQ ID NO: 117 - protein, 30 aa, Artificial Sequence; identical to SEQ ID NO: 88
  Chemically synthesized

SEQ ID NO: 118 - protein, 30 aa, Artificial Sequence; identical to SEQ ID NO: 88
  Chemically synthesized

SEQ ID NO: 119 - protein, 30 aa, Artificial Sequence
  Chemically synthesized
KKRSEKSMALRLAGELLEASEGRGGAMKKR

SEQ ID NO: 120 - protein, 29 aa, Artificial Sequence
  Chemically synthesized
KKRMKSIGTVEVPQEAFLAILKTDTSKKR

SEQ ID NO: 121 - protein, 30 aa, Artificial Sequence
  Chemically synthesized
KKRSEKSMALRLAGELLEAAEGRGGAMKKR

SEQ ID NO: 122 - protein, 30 aa, Artificial Sequence; identical to SEQ ID NO: 88
  Chemically synthesized

SEQ ID NO: 123 - protein, 42 aa, Artificial Sequence
  Chemically synthesized
KKRILNKAKGYWGSRGTILTVAKHAVDKAEQYAYRDRRVKKR

SEQ ID NO: 124 - protein, 44 aa, Artificial Sequence
  Chemically synthesized
KKRRKILKAVKGYHGALSRRYRLAKQAYIKAKKHAYVGRKLKKR

SEQ ID NO: 125 - protein, 26 aa, Artificial Sequence
  Chemically synthesized
KKRGIGVKVNNGILWLLELQPEGKKR

SEQ ID NO: 126 - protein, 44 aa, Artificial Sequence
  Chemically synthesized
KKRKKFLKEAKGYRGALSRRYKLAKQMYIRSKWYSYVGRKIKKR

SEQ ID NO: 127 - protein, 32 aa, Artificial Sequence
  Chemically synthesized
KKRFSVTGSGKVRRLKAYKSHILTKMSGKKKR

SEQ ID NO: 128 - protein, 43 aa, Artificial Sequence
  Chemically synthesized
KKRKYLKAAKGYRGALSRRYRLAKQYYIRSGVYAYVGRKQKKR

SEQ ID NO: 129 - protein, 42 aa, Artificial Sequence
  Chemically synthesized
KKRRAILEQASGYRGQRSRLYRKAKEQVTHSLVYNYNDRKKR

SEQ ID NO: 130 - protein, 46 aa, Artificial Sequence; identical to SEQ ID NO: 93
  Chemically synthesized

SEQ ID NO: 131 - protein, 46 aa, Artificial Sequence; identical to SEQ ID NO: 93
  Chemically synthesized

SEQ ID NO: 132 - protein, 27 aa, Artificial Sequence
  Chemically synthesized
KKRIPNTVFIFLVPPEKKALYDRLKKR

SEQ ID NO: 133 - protein, 46 aa, Artificial Sequence; identical to SEQ ID NO: 93
  Chemically synthesized

SEQ ID NO: 134 - protein, 40 aa, Artificial Sequence
  Chemically synthesized
KKRILDTLFTRSPKNQQDFIEHTDDKKSIVNFFVGAFKKR

SEQ ID NO: 135 - protein, 26 aa, Artificial Sequence
  Chemically synthesized
KKRELQELNQIRRNLEQSNASLLKKR

SEQ ID NO: 136 - protein, 37 aa, Artificial Sequence
  Chemically synthesized
KKRNHMAWVWGIVGLIQAPMPLICYYFFVIRPDRKKR

SEQ ID NO: 137 - protein, 40 aa, Artificial Sequence
  Chemically synthesized
KKRLFEEQQEAKKIDYANSRIKAIKLIGAIIFFMKSSKKR

SEQ ID NO: 138 - protein, 28 aa, Artificial Sequence
  Chemically synthesized
KKRKKIPGLAMIVIGNNPASLIYVNKKR

SEQ ID NO: 139 - protein, 27 aa, Artificial Sequence
  Chemically synthesized
KKRPELLIAFGGCMAQLPEVRQKLKKR

SEQ ID NO: 140 - protein, 30 aa, Artificial Sequence; identical to SEQ ID NO: 88
  Chemically synthesized

SEQ ID NO: 141 - protein, 30 aa, Artificial Sequence; identical to SEQ ID NO: 119
  Chemically synthesized

SEQ ID NO: 142 - protein, 32 aa, Artificial Sequence
  Chemically synthesized
KKRGYQKYGVRPRLAKKKTVMCKIARKQGKKR

SEQ ID NO: 143 - protein, 31 aa, Artificial Sequence
  Chemically synthesized
KKRSSHSKKQRGNKSRGFDQKSQRVSKGKKR

SEQ ID NO: 144 - protein, 32 aa, Artificial Sequence; identical to SEQ ID NO: 142
  Chemically synthesized

SEQ ID NO: 145 - protein, 31 aa, Artificial Sequence
  Chemically synthesized
KKRSSHSKKQRGNKSRGFDQKSQRSSKGKKR

SEQ ID NO: 146 - protein, 30 aa, Artificial Sequence; identical to SEQ ID NO: 92
  Chemically synthesized

SEQ ID NO: 147 - protein, 30 aa, Artificial Sequence; identical to SEQ ID NO: 88
  Chemically synthesized

SEQ ID NO: 148 - protein, 44 aa, Artificial Sequence
  Chemically synthesized
KKRRKLLKEARGYRGTKHTSYKRAKEQVWKSGVYAYVGRKQKKR

SEQ ID NO: 149 - protein, 30 aa, Artificial Sequence; identical to SEQ ID NO: 88
  Chemically synthesized

SEQ ID NO: 150 - protein, 46 aa, Artificial Sequence; identical to SEQ ID NO: 93
  Chemically synthesized

SEQ ID NO: 151 - protein, 46 aa, Artificial Sequence; identical to SEQ ID NO: 93
  Chemically synthesized

SEQ ID NO: 152 - protein, 46 aa, Artificial Sequence; identical to SEQ ID NO: 93
  Chemically synthesized

SEQ ID NO: 153 - protein, 46 aa, Artificial Sequence; identical to SEQ ID NO: 93
  Chemically synthesized

SEQ ID NO: 154 - protein, 30 aa, Artificial Sequence; identical to SEQ ID NO: 121
  Chemically synthesized

SEQ ID NO: 155 - protein, 30 aa, Artificial Sequence; identical to SEQ ID NO: 108
  Chemically synthesized

SEQ ID NO: 156 - protein, 27 aa, Artificial Sequence
  Chemically synthesized
KKRMPNTVFIFLVPPKKKDLYDRLKKR

SEQ ID NO: 157 - protein, 30 aa, Artificial Sequence; identical to SEQ ID NO: 88
  Chemically synthesized

SEQ ID NO: 158 - protein, 30 aa, Artificial Sequence; identical to SEQ ID NO: 88
  Chemically synthesized

SEQ ID NO: 159 - protein, 30 aa, Artificial Sequence; identical to SEQ ID NO: 88
  Chemically synthesized

SEQ ID NO: 160 - protein, 45 aa, Artificial Sequence
  Chemically synthesized
KKRKGMSNKKVLTGVVVATKCDKTIKVMVSRMVRHKTYKKIVKKR

SEQ ID NO: 161 - protein, 30 aa, Artificial Sequence; identical to SEQ ID NO: 119
  Chemically synthesized

SEQ ID NO: 162 - protein, 46 aa, Artificial Sequence; identical to SEQ ID NO: 93
  Chemically synthesized

SEQ ID NO: 163 - protein, 40 aa, Artificial Sequence
  Chemically synthesized
KKRILDTFFKRNNSNHKDFVEHEEKRKSLLKIAINAFKKR

SEQ ID NO: 164 - protein, 44 aa, Artificial Sequence
  Chemically synthesized
KKRDNTRLIHYEGTTRRGESYYVDVFSLMYPKMDILLEYASKKR

SEQ ID NO: 165 - protein, 30 aa, Artificial Sequence
  Chemically synthesized
KKRFALTGTGKIKRKHAFHSHILTKKSKKR

SEQ ID NO: 166 - protein, 41 aa, Artificial Sequence
  Chemically synthesized
KKRATVRIQGQTYKVVSSEEPAHVKEVASYMNKKMEELKKR

SEQ ID NO: 167 - protein, 46 aa, Artificial Sequence; identical to SEQ ID NO: 93
  Chemically synthesized

SEQ ID NO: 168 - protein, 30 aa, Artificial Sequence; identical to SEQ ID NO: 88
  Chemically synthesized

SEQ ID NO: 169 - protein, 30 aa, Artificial Sequence; identical to SEQ ID NO: 88
  Chemically synthesized

SEQ ID NO: 170 - protein, 30 aa, Artificial Sequence; identical to SEQ ID NO: 165
  Chemically synthesized

SEQ ID NO: 171 - protein, 30 aa, Artificial Sequence
  Chemically synthesized
KKREFETQGRKPHWRFLLPNFENDPLQKKR

SEQ ID NO: 172 - protein, 46 aa, Artificial Sequence
  Chemically synthesized
KKRKIIALCGIDTRALTVLIREKGALNGIIAHDPNGNFDINTLKKR

SEQ ID NO: 173 - protein, 36 aa, Artificial Sequence
  Chemically synthesized
KKRSRGVGSEGPAVFREKSTTQVDVEARKSQKDKKR

SEQ ID NO: 174 - protein, 42 aa, Artificial Sequence
  Chemically synthesized
KKRLFKLAKGFVGDRKNHLRLTSGAVMRAMAYNYAHRKQKKR

SEQ ID NO: 175 - protein, 36 aa, Artificial Sequence
  Chemically synthesized
KKRFERKKEASPADTPPESDSTTENASVEKKAEKKR

SEQ ID NO: 176 - protein, 27 aa, Artificial Sequence
  Chemically synthesized
KKRLDKEGVMKSVKAHRFYSKPSIKKR

SEQ ID NO: 177 - protein, 45 aa, Artificial Sequence
  Chemically synthesized
KKRPEQGRIAALYSDIVILADEDPRGEDSVELLEMIAAGCPEKKR

SEQ ID NO: 178 - protein, 36 aa, Artificial Sequence
  Chemically synthesized
KKRSLPNLRTVRVKLEDGTTVKLRVAASTLRTMKKR

SEQ ID NO: 179 - protein, 30 aa, Artificial Sequence
  Chemically synthesized
KKRFRLSAKGKAMHRQSGTSHLAKGLSKKR

SEQ ID NO: 180 - protein, 30 aa, Artificial Sequence; identical to SEQ ID NO: 108
  Chemically synthesized

SEQ ID NO: 181 - protein, 30 aa, Artificial Sequence; identical to SEQ ID NO: 108
  Chemically synthesized

SEQ ID NO: 182 - protein, 30 aa, Artificial Sequence; identical to SEQ ID NO: 108
  Chemically synthesized

SEQ ID NO: 183 - protein, 42 aa, Artificial Sequence; identical to SEQ ID NO: 114
  Chemically synthesized

SEQ ID NO: 184 - protein, 42 aa, Artificial Sequence
  Chemically synthesized
KKRIQYNERLEFLGDSVLQLVITEYLFMNYKDKSEGELSKKR

SEQ ID NO: 185 - protein, 30 aa, Artificial Sequence
  Chemically synthesized
KKRFTLTGTGKIKRKHAFHSHILTKKSKKR

SEQ ID NO: 186 - protein, 43 aa, Artificial Sequence
  Chemically synthesized
KKRDLENCSYQASGISVVSHPKNPYVPTSHLNIRFFLAKNKKR

SEQ ID NO: 187 - protein, 26 aa, Artificial Sequence
  Chemically synthesized
KKRRDFLKNNHVSFLISIHADSSKKR

SEQ ID NO: 188 - protein, 46 aa, Artificial Sequence; identical to SEQ ID NO: 93
  Chemically synthesized

SEQ ID NO: 189 - protein, 32 aa, Artificial Sequence; identical to SEQ ID NO: 142
  Chemically synthesized

SEQ ID NO: 190 - protein, 31 aa, Artificial Sequence
  Chemically synthesized
KKRSSHSKKQRGNKSRGFDQKSQRGSKGKKR

SEQ ID NO: 191 - protein, 30 aa, Artificial Sequence; identical to SEQ ID NO: 119
  Chemically synthesized

SEQ ID NO: 192 - protein, 30 aa, Artificial Sequence
  Chemically synthesized
KKREIFTSIFEDKIDLKLFSFLIILIEKKR

SEQ ID NO: 193 - protein, 31 aa, Artificial Sequence
  Chemically synthesized
KKRARRPGVPTRGDKKRAPRLGVPARGDKKR

SEQ ID NO: 194 - protein, 31 aa, Artificial Sequence
  Chemically synthesized
KKRAPRLGVPARGDKKRARRPGVPAREDKKR

SEQ ID NO: 195 - protein, 31 aa, Artificial Sequence
  Chemically synthesized
KKRARRPGVPAREDKKRAPRPGVPTRGDKKR

SEQ ID NO: 196 - protein, 31 aa, Artificial Sequence
  Chemically synthesized
KKRAPRPGVPTRGDKKRAPRLGVPARGDKKR

SEQ ID NO: 197 - protein, 45 aa, Artificial Sequence
  Chemically synthesized
KKRARRPGVPTRGDKKRAPRLGVPARGDKKRARRPGVPAREDKKR

SEQ ID NO: 198 - protein, 45 aa, Artificial Sequence
  Chemically synthesized
KKRAPRLGVPARGDKKRARRPGVPAREDKKRAPRPGVPTRGDKKR

SEQ ID NO: 199 - protein, 45 aa, Artificial Sequence
  Chemically synthesized
KKRARRPGVPAREDKKRAPRPGVPTRGDKKRAPRLGVPARGDKKR

SEQ ID NO: 200 - protein, 44 aa, Artificial Sequence; identical to SEQ ID NO: 113
  Chemically synthesized

SEQ ID NO: 201 - protein, 45 aa, Artificial Sequence
  Chemically synthesized
KKRTSVPDDDFVFTLSDDENDVLENGADEGDEQADEETASGSKKR

SEQ ID NO: 202 - protein, 38 aa, Artificial Sequence
  Chemically synthesized
KKRAAAKDDDFVLTLSDDENDVLENGVEEDTLSSSKKR

SEQ ID NO: 203 - protein, 42 aa, Artificial Sequence
  Chemically synthesized
KKRLQKQAKEEERARREAEKAAEEAAAKAEQEKKLEEQRKKR

SEQ ID NO: 204 - protein, 45 aa, Artificial Sequence
  Chemically synthesized
KKRANADDDFVLTLSDDENDTLNQLEEEGEGDDGALATGSKTKKR

SEQ ID NO: 205 - protein, 44 aa, Artificial Sequence
  Chemically synthesized
KKRAQETKIDSKESVKESPKQENSILKRLASSIKKQELPFTKKR

SEQ ID NO: 206 - protein, 46 aa, Artificial Sequence
  Chemically synthesized
KKRSAEEEEKDLKKIMMTNKQRKLYNKMQYGINKKETRQDELAKKR

SEQ ID NO: 207 - protein, 35 aa, Artificial Sequence
  Chemically synthesized
KKRKAHEERKEEKRSYKKTKSDRSAPKTKAKSKKR

SEQ ID NO: 208 - protein, 41 aa, Artificial Sequence
  Chemically synthesized
KKRTIDKVDDSVEDGAEKKPEAAVKNDGETAEKPEKKHKKR

SEQ ID NO: 209 - protein, 39 aa, Artificial Sequence
  Chemically synthesized
KKRKANEERKEEGKERSYKKTKADRTKLKTKAKSSSKKR

SEQ ID NO: 210 - protein, 26 aa, Artificial Sequence
  Chemically synthesized
KKRAAQKKKEEEELERQKMMMSRKKR

SEQ ID NO: 211 - protein, 38 aa, Artificial Sequence
  Chemically synthesized
KKRKREIERLEKMTDEEKKEEQAKEKELQDLIEQVKKR

SEQ ID NO: 212 - protein, 26 aa, Artificial Sequence
  Chemically synthesized
KKRGHNSIIGHEKTNALETLKKKKKR

SEQ ID NO: 213 - protein, 43 aa, Artificial Sequence
  Chemically synthesized
KKRSAKIKKATFDANKKKEVGVSDLTLLSKISDESINENLKKR

SEQ ID NO: 214 - protein, 37 aa, Artificial Sequence
  Chemically synthesized
KKRKAREILDKHRKEEKELVKEGKTPYYLKKAEQKKR

SEQ ID NO: 215 - protein, 39 aa, Artificial Sequence
  Chemically synthesized
KKRTHDELEQDGKEEEEKKEGEKPSSQNRAERDEPEKKR

SEQ ID NO: 216 - protein, 35 aa, Artificial Sequence
  Chemically synthesized
KKRSLEDNETEIKVSRDTWNTKNMRSLEPPRSKKR

SEQ ID NO: 217 - protein, 35 aa, Artificial Sequence; identical to SEQ ID NO: 216
  Chemically synthesized

SEQ ID NO: 218 - protein, 45 aa, Artificial Sequence
  Chemically synthesized
KKRLPQAKRACAKCQKDNKKCDDARPCQRCIKAKTDCIDLPRKKR

SEQ ID NO: 219 - protein, 26 aa, Artificial Sequence
  Chemically synthesized
KKRNSEEANDENDETNLKIPIPEKKR

SEQ ID NO: 220 - protein, 37 aa, Artificial Sequence
  Chemically synthesized
KKRKVNELSQDVISLHSPKESNARKTKKNKNKKKKKR

SEQ ID NO: 221 - protein, 34 aa, Artificial Sequence
  Chemically synthesized
KKRKSKSKQESSDSGVSEDDEIPLSDARNKTKKR

SEQ ID NO: 222 - protein, 45 aa, Artificial Sequence
  Chemically synthesized
KKRKLKDTVSNCEFTEEDSESSFLLETIQPTKSTLRRSISPLKKR

SEQ ID NO: 223 - protein, 35 aa, Artificial Sequence
  Chemically synthesized
KKRAEKKEQQKEKKKEKEKERMKAFIPPEESSKKR

SEQ ID NO: 224 - protein, 35 aa, Artificial Sequence
  Chemically synthesized
KKRSANELAIDDQDTKESTDLAGTEDSAPKANKKR

SEQ ID NO: 225 - protein, 44 aa, Artificial Sequence
  Chemically synthesized
KKRLTYSELFHKTQELNEELQSCLQKILEASADRNESKQDAKKR

SEQ ID NO: 226 - protein, 31 aa, Artificial Sequence
  Chemically synthesized
KKRTKIQCSHFDLLVKLGQGGYGSVWLAKKR

SEQ ID NO: 227 - protein, 35 aa, Artificial Sequence
  Chemically synthesized
KKRKSKLVEMTPKGLKKRKRVQIQEGSVSTNTKKR

SEQ ID NO: 228 - protein, 42 aa, Artificial Sequence
  Chemically synthesized
KKRNVEEQNLIEQSITESQRIFSEKQRLEQERFNRELLEKKR

SEQ ID NO: 229 - protein, 35 aa, Artificial Sequence; identical to SEQ ID NO: 216
  Chemically synthesized

SEQ ID NO: 230 - protein, 35 aa, Artificial Sequence; identical to SEQ ID NO: 216
  Chemically synthesized

SEQ ID NO: 231 - protein, 35 aa, Artificial Sequence; identical to SEQ ID NO: 216
  Chemically synthesized

SEQ ID NO: 232 - protein, 35 aa, Artificial Sequence; identical to SEQ ID NO: 216
  Chemically synthesized

SEQ ID NO: 233 - protein, 35 aa, Artificial Sequence; identical to SEQ ID NO: 216
  Chemically synthesized

SEQ ID NO: 234 - protein, 35 aa, Artificial Sequence; identical to SEQ ID NO: 216
  Chemically synthesized

SEQ ID NO: 235 - protein, 35 aa, Artificial Sequence; identical to SEQ ID NO: 216
  Chemically synthesized

SEQ ID NO: 236 - protein, 35 aa, Artificial Sequence; identical to SEQ ID NO: 216
  Chemically synthesized

SEQ ID NO: 237 - protein, 35 aa, Artificial Sequence
  Chemically synthesized
KKRSLEDNETEIEVSRDTWNNKNMRSLEPPRSKKR

SEQ ID NO: 238 - protein, 35 aa, Artificial Sequence; identical to SEQ ID NO: 237
  Chemically synthesized

SEQ ID NO: 239 - protein, 40 aa, Artificial Sequence
  Chemically synthesized
KKRVEKLDWMYAAPSTEGGALGGARIGERDMEEYLLGKKR

SEQ ID NO: 240 - protein, 40 aa, Artificial Sequence; identical to SEQ ID NO: 239
  Chemically synthesized

SEQ ID NO: 241 - protein, 35 aa, Artificial Sequence; identical to SEQ ID NO: 237
  Chemically synthesized

SEQ ID NO: 242 - protein, 35 aa, Artificial Sequence; identical to SEQ ID NO: 237
  Chemically synthesized

SEQ ID NO: 243 - protein, 29 aa, Artificial Sequence
  Chemically synthesized
KKRKRRSKKINKLTDGQIRINHVSSEKKR

SEQ ID NO: 244 - protein, 37 aa, Artificial Sequence
  Chemically synthesized
KKRSKLTSKHAETADSQSSAASSDHESGQSQAHTKKR

SEQ ID NO: 245 - protein, 39 aa, Artificial Sequence
  Chemically synthesized
KKRDAETADIGDQSEVESDTEELKKIMFGEKKKLNKKKR

SEQ ID NO: 246 - protein, 29 aa, Artificial Sequence
  Chemically synthesized
KKRAGGTKRKKATAEPSDNDILSQMTKKR

SEQ ID NO: 247 - protein, 35 aa, Artificial Sequence; identical to SEQ ID NO: 237
  Chemically synthesized

SEQ ID NO: 248 - protein, 33 aa, Artificial Sequence
  Chemically synthesized
KKRVYYDDGLTEEQFLEAVEDDNMSLEDAIKKR

SEQ ID NO: 249 - protein, 43 aa, Artificial Sequence
  Chemically synthesized
KKRSAKIKKATFDANKKKEVGISDLTLLSKISDESINENLKKR

SEQ ID NO: 250 - protein, 37 aa, Artificial Sequence
  Chemically synthesized
KKRKRLESEQEQDQDEIASDSDMEDIDSDLENNSKKR

SEQ ID NO: 251 - protein, 26 aa, Artificial Sequence
  Chemically synthesized
KKRGHNSIIGHEKTNALETLKKKKKR

SEQ ID NO: 252 - protein, 35 aa, Artificial Sequence; identical to SEQ ID NO: 216
  Chemically synthesized

SEQ ID NO: 253 - protein, 35 aa, Artificial Sequence; identical to SEQ ID NO: 216
  Chemically synthesized

SEQ ID NO: 254 - protein, 35 aa, Artificial Sequence
  Chemically synthesized
KKRAHSSGERRSSVSKPARDPSDKPEESPSKKKKR

SEQ ID NO: 255 - protein, 42 aa, Artificial Sequence
  Chemically synthesized
KKRLKSSLRFRKLEILLELPFFIPFEERVDLFYMFIALDKKR

SEQ ID NO: 256 - protein, 35 aa, Artificial Sequence
  Chemically synthesized
KKRMQAVFTNVHKFKPDASRDESKETYYIGLKKKR

SEQ ID NO: 257 - protein, 35 aa, Artificial Sequence
  Chemically synthesized
KKRKPTEVNDSENNSSEEDKKKGQNVTSETHSKKR

SEQ ID NO: 258 - protein, 42 aa, Artificial Sequence
  Chemically synthesized
KKREAEAQWCRIHGQSCWKRDALPEAEPQWCRIHGQSCWKKR

SEQ ID NO: 259 - protein, 35 aa, Artificial Sequence; identical to SEQ ID NO: 216
  Chemically synthesized

SEQ ID NO: 260 - protein, 35 aa, Artificial Sequence; identical to SEQ ID NO: 237
  Chemically synthesized

SEQ ID NO: 261 - protein, 35 aa, Artificial Sequence; identical to SEQ ID NO: 216
  Chemically synthesized

SEQ ID NO: 262 - protein, 35 aa, Artificial Sequence; identical to SEQ ID NO: 216
  Chemically synthesized

SEQ ID NO: 263 - protein, 45 aa, Artificial Sequence
  Chemically synthesized
KKRKDPDSDDWSESNSKENKIDNKHLNLLSSDSEIEQDYQKAKKR

SEQ ID NO: 264 - protein, 35 aa, Artificial Sequence; identical to SEQ ID NO: 216
  Chemically synthesized

SEQ ID NO: 265 - protein, 35 aa, Artificial Sequence; identical to SEQ ID NO: 216
  Chemically synthesized

SEQ ID NO: 266 - protein, 35 aa, Artificial Sequence
  Chemically synthesized
KKRVIDDEDDKEVDTTLPGWGEWAGAGSKPKNKKR

SEQ ID NO: 267 - protein, 35 aa, Artificial Sequence; identical to SEQ ID NO: 216
  Chemically synthesized

SEQ ID NO: 268 - protein, 35 aa, Artificial Sequence; identical to SEQ ID NO: 216
  Chemically synthesized

SEQ ID NO: 269 - protein, 26 aa, Artificial Sequence
  Chemically synthesized
KKRRRGNGKHLSRKEKRKMERADKKR

SEQ ID NO: 270 - protein, 35 aa, Artificial Sequence; identical to SEQ ID NO: 216
  Chemically synthesized

SEQ ID NO: 271 - protein, 40 aa, Artificial Sequence
  Chemically synthesized
KKRNGSMHNMYYASVPFLLFSNAYSIDFSRHVNEFLEKKR

SEQ ID NO: 272 - protein, 35 aa, Artificial Sequence; identical to SEQ ID NO: 237
  Chemically synthesized

SEQ ID NO: 273 - protein, 35 aa, Artificial Sequence; identical to SEQ ID NO: 216
  Chemically synthesized

SEQ ID NO: 274 - protein, 28 aa, Artificial Sequence
  Chemically synthesized
KKRYMTTKQTRTVQNQTMPRSNTTTKKR

SEQ ID NO: 275 - protein, 37 aa, Artificial Sequence
  Chemically synthesized
KKREFEAAPAKTYADFLRAYQSWNTFVNPDRPNLKKR

SEQ ID NO: 276 - protein, 37 aa, Artificial Sequence
  Chemically synthesized
KKREFEAAPEKSYADFLRAYHSWNTFVNPDRPNLKKR

SEQ ID NO: 277 - protein, 37 aa, Artificial Sequence; identical to SEQ ID NO: 275
  Chemically synthesized

SEQ ID NO: 278 - protein, 46 aa, Artificial Sequence
  Chemically synthesized
KKRDKKKQLKLAKEEERQRREAERLAEQAAQKALEAKRQEEARKKR

SEQ ID NO: 279 - protein, 26 aa, Artificial Sequence
  Chemically synthesized
KKREALLNIEEGRDVKGNRMVGMKKR

SEQ ID NO: 280 - protein, 35 aa, Artificial Sequence; identical to SEQ ID NO: 216
  Chemically synthesized

SEQ ID NO: 281 - protein, 35 aa, Artificial Sequence; identical to SEQ ID NO: 216
  Chemically synthesized

SEQ ID NO: 282 - protein, 35 aa, Artificial Sequence; identical to SEQ ID NO: 237
  Chemically synthesized

SEQ ID NO: 283 - protein, 35 aa, Artificial Sequence; identical to SEQ ID NO: 216
  Chemically synthesized

SEQ ID NO: 284 - protein, 35 aa, Artificial Sequence; identical to SEQ ID NO: 216
  Chemically synthesized

SEQ ID NO: 285 - protein, 35 aa, Artificial Sequence; identical to SEQ ID NO: 216
  Chemically synthesized

SEQ ID NO: 286 - protein, 35 aa, Artificial Sequence; identical to SEQ ID NO: 216
  Chemically synthesized

SEQ ID NO: 287 - protein, 35 aa, Artificial Sequence; identical to SEQ ID NO: 216
  Chemically synthesized

SEQ ID NO: 288 - protein, 35 aa, Artificial Sequence; identical to SEQ ID NO: 237
  Chemically synthesized

SEQ ID NO: 289 - protein, 41 aa, Artificial Sequence
  Chemically synthesized
KKRKLGPKAPNPLSVKKKKKVNSPSDEVKDKEDTSKEKKKR

SEQ ID NO: 290 - protein, 35 aa, Artificial Sequence; identical to SEQ ID NO: 216
  Chemically synthesized

SEQ ID NO: 291 - protein, 35 aa, Artificial Sequence; identical to SEQ ID NO: 237
  Chemically synthesized

SEQ ID NO: 292 - protein, 35 aa, Artificial Sequence; identical to SEQ ID NO: 216
  Chemically synthesized

SEQ ID NO: 293 - protein, 35 aa, Artificial Sequence; identical to SEQ ID NO: 237
  Chemically synthesized

SEQ ID NO: 294 - protein, 35 aa, Artificial Sequence; identical to SEQ ID NO: 237
  Chemically synthesized

SEQ ID NO: 295 - protein, 31 aa, Artificial Sequence
  Chemically synthesized
KKRKGGNGSSDEEEDSDDDMAGKDKGKRKKR

SEQ ID NO: 296 - protein, 45 aa, Artificial Sequence
  Chemically synthesized
KKRKRKHGGSGNAALTSANAAKSLVKTTLSSKGEASAEKQEMKKR

SEQ ID NO: 297 - protein, 26 aa, Artificial Sequence
  Chemically synthesized
KKRKADRRSDKEDDKLGKKEKKSKKR

SEQ ID NO: 298 - protein, 44 aa, Artificial Sequence
  Chemically synthesized
KKRDKKEKKERRDKKEKKEKRRIEKAAAESGAETGDSISEEKKR

SEQ ID NO: 299 - protein, 46 aa, Artificial Sequence
  Chemically synthesized
KKRTAPKDDDFVLTLSDDENDVFSGINEDGDDHLDEETAKSTTKKR

SEQ ID NO: 300 - protein, 42 aa, Artificial Sequence
  Chemically synthesized
KKRVDEAREKRVGRFRDGMGSKKELKGREDIRKARIEKEKKR

SEQ ID NO: 301 - protein, 34 aa, Artificial Sequence
  Chemically synthesized
KKRIDRVDWMYATPATTGSGSAAEMEDYLLGKKR

SEQ ID NO: 302 - protein, 34 aa, Artificial Sequence
  Chemically synthesized
KKRKTSDRETQNVTTKKQKIETIERKKSSLKKKR

SEQ ID NO: 303 - protein, 45 aa, Artificial Sequence
  Chemically synthesized
KKRAAARDDDFVLTLSDDENDIFENGVEEDGDNAQEDTLSSSKKR

SEQ ID NO: 304 - protein, 42 aa, Artificial Sequence; identical to SEQ ID NO: 203
  Chemically synthesized

SEQ ID NO: 305 - protein, 41 aa, Artificial Sequence
  Chemically synthesized
KKRLQQLAKEEERKRKEEELKAKEEEQRLQKEKLKAEQKKR

SEQ ID NO: 306 - protein, 37 aa, Artificial Sequence
  Chemically synthesized
KKRSEIERYSKMFWQNYQKIEGYEKYLSQIEAVEKKR

SEQ ID NO: 307 - protein, 27 aa, Artificial Sequence
  Chemically synthesized
KKRVAPLLVSTSAAPKNVLQKPLEKKR

SEQ ID NO: 308 - protein, 26 aa, Artificial Sequence
  Chemically synthesized
KKRAAKKRQEEEELERQKMMMSRKKR

SEQ ID NO: 309 - protein, 46 aa, Artificial Sequence
  Chemically synthesized
KKRSAEDEEKDLKKIMMSNKQRKLYKKMQYGIDKKEARQDDLTKKR

SEQ ID NO: 310 - protein, 44 aa, Artificial Sequence
  Chemically synthesized
KKRGSEAVEESDSDSEESESESDDDKKSRKSSKKEKKDKKSKKR

SEQ ID NO: 311 - protein, 41 aa, Artificial Sequence
  Chemically synthesized
KKRAEKSRTPLTSSTAVISDRPVASVSADTTLVGSVASKKR

SEQ ID NO: 312 - protein, 34 aa, Artificial Sequence
  Chemically synthesized
KKRFSGSSVTVAMTTAAAAAARLTAFKVTKPKKR

SEQ ID NO: 313 - protein, 28 aa, Artificial Sequence
  Chemically synthesized
KKREVGVSDLTLLSKVSEEAINENLKKR

SEQ ID NO: 314 - protein, 33 aa, Artificial Sequence
  Chemically synthesized
KKRLKRTKVPSKIWVDNLNMEYIYAKGESIKKR

SEQ ID NO: 315 - protein, 39 aa, Artificial Sequence
  Chemically synthesized
KKRYKSELDRAEAIERQLIREEEHLKSLQEKGETQAKKR

SEQ ID NO: 316 - protein, 41 aa, Artificial Sequence
  Chemically synthesized
KKRKLEVKSDQQTPPATQSEINHTSSVRLEENIQGIKRKKR

SEQ ID NO: 317 - protein, 39 aa, Artificial Sequence
  Chemically synthesized
KKRGQAAKEAVEVDLVDVGDYVKKATERFQHTVELHKKR

SEQ ID NO: 318 - protein, 33 aa, Artificial Sequence
  Chemically synthesized
KKRQRKRRREAGSGDEEDEGVSDEVLAARAKKR

SEQ ID NO: 319 - protein, 42 aa, Artificial Sequence
  Chemically synthesized
KKRVAEAKEKRIGKYKDGEGSKRELKTATDIRKARAVAEKKR

SEQ ID NO: 320 - protein, 34 aa, Artificial Sequence
  Chemically synthesized
KKRDPPPRPKYEVFTDAQLSREIASYGFKPIKKR

SEQ ID NO: 321 - protein, 39 aa, Artificial Sequence
  Chemically synthesized
KKRGISALMAKAKEASDVATNGYFKHWDGGVSEDDEKKR

SEQ ID NO: 322 - protein, 28 aa, Artificial Sequence
  Chemically synthesized
KKRQSKRLTTRKREGMLKRARANERKKR

SEQ ID NO: 323 - protein, 27 aa, Artificial Sequence
  Chemically synthesized
KKRKKKTVKELNRIRRASRISKKEKKR

SEQ ID NO: 324 - protein, 38 aa, Artificial Sequence
  Chemically synthesized
KKRKKKTVKELNRIRRASRISKKEKKRIFKRYIGMKKR

SEQ ID NO: 325 - protein, 35 aa, Artificial Sequence; identical to SEQ ID NO: 216
  Chemically synthesized

SEQ ID NO: 326 - protein, 41 aa, Artificial Sequence
  Chemically synthesized
KKRTGSQYSYYNGGHNVESTNENKLVDASDLLANVDILKKR

SEQ ID NO: 327 - protein, 35 aa, Artificial Sequence; identical to SEQ ID NO: 216
  Chemically synthesized

SEQ ID NO: 328 - protein, 35 aa, Artificial Sequence; identical to SEQ ID NO: 216
  Chemically synthesized

SEQ ID NO: 329 - protein, 40 aa, Artificial Sequence
  Chemically synthesized
KKRVWSREKRLLSEMAITNHSPLLNVDDYRKFREDLWKKR

SEQ ID NO: 330 - protein, 33 aa, Artificial Sequence
  Chemically synthesized
KKRKRRAKAAEREAQEAEELSMELGLDENLKKR

SEQ ID NO: 331 - protein, 35 aa, Artificial Sequence
  Chemically synthesized
KKRRRSSSYSPSPVKKKKKKSSKKHKRRRSFSKKR

SEQ ID NO: 332 - protein, 40 aa, Artificial Sequence
  Chemically synthesized
KKRKKPKGKETFEPEDKTVKQEQINTEPLEDTVLSPTKKR

SEQ ID NO: 333 - protein, 42 aa, Artificial Sequence
  Chemically synthesized
KKRKKQSQESRMPETVPQEEMPGPPLNSESGEEAPTGRDKKR

SEQ ID NO: 334 - protein, 43 aa, Artificial Sequence
  Chemically synthesized
KKRKRQKGTEGMEPEEGVTVESQPQVKVEPLEEAIPLPPTKKR

SEQ ID NO: 335 - protein, 26 aa, Artificial Sequence
  Chemically synthesized
KKRKLDPEIVPEEKDCGDAEGNSKKR

SEQ ID NO: 336 - protein, 46 aa, Artificial Sequence
  Chemically synthesized
KKRSSIWQFFSRLFSSSSNTTKKPEPPVNLKYNAPTSHVTPSVKKR

SEQ ID NO: 337 - protein, 36 aa, Artificial Sequence
  Chemically synthesized
KKRRAPPPPGSGPPVQDKASEKVSLGSQIDLQKKKR

SEQ ID NO: 338 - protein, 37 aa, Artificial Sequence
  Chemically synthesized
KKRQRSESRSASEHSSSAESERSYKKSKKHKKKSKKR

SEQ ID NO: 339 - protein, 32 aa, Artificial Sequence
  Chemically synthesized
KKRKALEFVTNPDIAAKKKMKKHKNKSEAKKR

SEQ ID NO: 340 - protein, 45 aa, Artificial Sequence
  Chemically synthesized
KKRFRQLSILVHPDKNQDDADRAQKAFEAVDKAYKLLLDQEQKKR

SEQ ID NO: 341 - protein, 45 aa, Artificial Sequence
  Chemically synthesized
KKRQQARKTASVLSKDDVAPESGDTTVKKPESKKEQTPEHGKKKR

SEQ ID NO: 342 - protein, 42 aa, Artificial Sequence
  Chemically synthesized
KKRARLEEENEELRQRLIETELAKQVLQTELERPREHSLKKR

SEQ ID NO: 343 - protein, 35 aa, Artificial Sequence
  Chemically synthesized
KKRRHRSKVNGLQRGRKKDRPRKHLTLNNKVQKKR

SEQ ID NO: 344 - protein, 30 aa, Artificial Sequence
  Chemically synthesized
KKRRKEKKVKHKKKGKKQKHCRRHKQTKKR

SEQ ID NO: 345 - protein, 26 aa, Artificial Sequence
  Chemically synthesized
KKRPRNSYKCGTNTMEREESEQTKKR

SEQ ID NO: 346 - protein, 35 aa, Artificial Sequence
  Chemically synthesized
KKRQTQSESSNYDSELEKEIKSMSKIGAARTTKKR

SEQ ID NO: 347 - protein, 41 aa, Artificial Sequence
  Chemically synthesized
KKRGRKPGSVVAAAAAEAKKKAVKESSIRSVQETVLPIKKR

SEQ ID NO: 348 - protein, 27 aa, Artificial Sequence
  Chemically synthesized
KKRGDGFVNESRLQKIVSVIDEEIKKR

SEQ ID NO: 349 - protein, 27 aa, Artificial Sequence
  Chemically synthesized
KKRKERFGIVTSSAGTGTTEDTEAKKR

SEQ ID NO: 350 - protein, 40 aa, Artificial Sequence
  Chemically synthesized
KKRKREESVEQKRSKQNATKLSALLFKHKEQLRAEILKKR

SEQ ID NO: 351 - protein, 33 aa, Artificial Sequence
  Chemically synthesized
KKRKEEERKKKETDQKKEAVAPVQEESDLEKKR

SEQ ID NO: 352 - protein, 43 aa, Artificial Sequence
  Chemically synthesized
KKRHKSSSSSSSSSSDSDSSSDSQSSSDSSDSESATEEKSKKR

SEQ ID NO: 353 - protein, 34 aa, Artificial Sequence
  Chemically synthesized
KKRKKDFQHLISSPLKKSRICDETANATSTLKKR

SEQ ID NO: 354 - protein, 37 aa, Artificial Sequence
  Chemically synthesized
KKRKKDFQHLISSPLKKSRICDETANATSTLKKRKKR

SEQ ID NO: 355 - protein, 45 aa, Artificial Sequence
  Chemically synthesized
KKRDQTASAPATPLVNKHRPTFTRSNTISKPYISNTLPSDAPKKR

SEQ ID NO: 356 - protein, 36 aa, Artificial Sequence
  Chemically synthesized
KKRKNKSSKRKHRKYSDSDSNSESDTNSDSDDDKKR

SEQ ID NO: 357 - protein, 39 aa, Artificial Sequence
  Chemically synthesized
KKRRQKEEEEATASERNDADEKHPEHAEQNIRKSKKKKR

SEQ ID NO: 358 - protein, 46 aa, Artificial Sequence
  Chemically synthesized
KKRQQQEEEDLNLEDRGEETVLGGGTREAESRACSDGRSRKSKKKR

SEQ ID NO: 359 - protein, 38 aa, Artificial Sequence
  Chemically synthesized
KKRIELKHDKKARAMAKRTKDNFHGYNGIPIEEKSKKR

SEQ ID NO: 360 - protein, 41 aa, Artificial Sequence
  Chemically synthesized
KKRIERFYNCLQHALERETMTNLHPKIKEKNNSSYIHKKKR

SEQ ID NO: 361 - protein, 26 aa, Artificial Sequence
  Chemically synthesized
KKRRKGSGSEQEGEDEEGGERKKKKR

SEQ ID NO: 362 - protein, 27 aa, Artificial Sequence
  Chemically synthesized
KKRRRHPKGEEGSDDDETENGPKPKKR

SEQ ID NO: 363 - protein, 37 aa, Artificial Sequence
  Chemically synthesized
KKRGGGGGRRSKKGGEFDEFVNDDTDDDLPISKKKKR

SEQ ID NO: 364 - protein, 36 aa, Artificial Sequence
  Chemically synthesized
KKRTALHLACANGNSEVVSLLLDRQCQLHVFDSKKR

SEQ ID NO: 365 - protein, 39 aa, Artificial Sequence
  Chemically synthesized
KKRKRKEEGEKEKKPRKKVPKQLGVVALNSHKSEKKKKR

SEQ ID NO: 366 - protein, 46 aa, Artificial Sequence
  Chemically synthesized
KKRLDGIEEVEREITRGRSRKGSELTCPEDNKIKELTLEIERLKKR

SEQ ID NO: 367 - protein, 33 aa, Artificial Sequence
  Chemically synthesized
KKRKKSYPDDKPLSSESSSESDYEEDVQAKKKR

SEQ ID NO: 368 - protein, 43 aa, Artificial Sequence
  Chemically synthesized
KKRKALEAKKEEEEIQREMVKLRREIIERRRTVKAAWKIEKKR

SEQ ID NO: 369 - protein, 37 aa, Artificial Sequence
  Chemically synthesized
KKRKRCGVCEPCQQKTNCGECTYCKNRKNSHQICKKR

SEQ ID NO: 370 - protein, 39 aa, Artificial Sequence
  Chemically synthesized
KKRMEAEQEMVRMVRAATLIQALWKGYLVRSLLRSKKKR

SEQ ID NO: 371 - protein, 31 aa, Artificial Sequence
  Chemically synthesized
KKRGRTPKTLISHPISAPSKTAEPLKFPKKR

SEQ ID NO: 372 - protein, 27 aa, Artificial Sequence
  Chemically synthesized
KKRVGDGSVLRTIHGKEMSKIARKKKR

SEQ ID NO: 373 - protein, 35 aa, Artificial Sequence
  Chemically synthesized
KKRKDEGKSRTTLPERPLTEVKAETRAEEAPEKKR

SEQ ID NO: 374 - protein, 32 aa, Artificial Sequence
  Chemically synthesized
KKRKSEDGTPAEDGTPAATGGSQPPSMGRKKR

SEQ ID NO: 375 - protein, 35 aa, Artificial Sequence
  Chemically synthesized
KKRKKRKSEDGTPAEDGTPAATGGSQPPSMGRKKR

SEQ ID NO: 376 - protein, 33 aa, Artificial Sequence
  Chemically synthesized
KKRKKISGPNPLSCLKKKKKAPDTQSSASEKKR

SEQ ID NO: 377 - protein, 32 aa, Artificial Sequence
  Chemically synthesized
KKRSREDAGDNDDTEGAIGVRNKVAGGKMKKR

SEQ ID NO: 378 - protein, 42 aa, Artificial Sequence
  Chemically synthesized
KKRKGSSSQAPASKKLNKEELPVIPKGKPKSGRVWKDRSKKR

SEQ ID NO: 379 - protein, 44 aa, Artificial Sequence
  Chemically synthesized
KKRSKLKHRDLEVSCEPDGFEMNFQCAPPLPSDTDQPQETVKKR

SEQ ID NO: 380 - protein, 45 aa, Artificial Sequence
  Chemically synthesized
KKRRKKSAGERLKEEKPKKSKTSGASKTKGKSKLNTITPVVGKKR

SEQ ID NO: 381 - protein, 29 aa, Artificial Sequence
  Chemically synthesized
KKRKKGEKQIPGEEKGRKRRRVKEDKKKR

SEQ ID NO: 382 - protein, 32 aa, Artificial Sequence
  Chemically synthesized
KKREAEEKEKRVRIAKELAERERLERQQKKKR

SEQ ID NO: 383 - protein, 31 aa, Artificial Sequence
  Chemically synthesized
KKRAATTVLQELKKLPPLPVVEKPKLFFKKR

SEQ ID NO: 384 - protein, 34 aa, Artificial Sequence
  Chemically synthesized
KKRGLTGDSKKATKESGLISTKKRKMVEMLEKKR

SEQ ID NO: 385 - protein, 27 aa, Artificial Sequence
  Chemically synthesized
KKRKREKKELKLENHQENSRNQKPKKR

SEQ ID NO: 386 - protein, 44 aa, Artificial Sequence
  Chemically synthesized
KKRSYKDFLREEEEIAAQVRNSSKKKLKDSELYFLGTDTHKKKR

SEQ ID NO: 387 - protein, 34 aa, Artificial Sequence
  Chemically synthesized
KKRQLLDSDEEQEEDEGRNRAPELGAPGIQKKKR

SEQ ID NO: 388 - protein, 38 aa, Artificial Sequence
  Chemically synthesized
KKRGKKKHIKEEPLSEEEPCTSTAIASPEKKKKKKKKR

SEQ ID NO: 389 - protein, 39 aa, Artificial Sequence
  Chemically synthesized
KKRGRPKKQPLLTVETIHEGTSTSPVSPISREFPGTKKR

SEQ ID NO: 390 - protein, 40 aa, Artificial Sequence
  Chemically synthesized
KKRKGKVKKTKKKKTSNKKEKTKKSKSKNKKDAKKKAKKR

SEQ ID NO: 391 - protein, 41 aa, Artificial Sequence
  Chemically synthesized
KKRKFTKEDAIYGVFNDGWGDYEDEEESKMTEEEYYKMKKR

SEQ ID NO: 392 - protein, 32 aa, Artificial Sequence
  Chemically synthesized
KKRKRATTTEEPQGSRNELVALENIEGIYKKR

SEQ ID NO: 393 - protein, 38 aa, Artificial Sequence
  Chemically synthesized
KKRGPKKKKYKPEAAEVEKKNEEGDTVKENPIAEAKKR

SEQ ID NO: 394 - protein, 40 aa, Artificial Sequence
  Chemically synthesized
KKRINEVSTTEGAPAEKKKKVEKWLNTSSEDGEGTKKKKR

SEQ ID NO: 395 - protein, 32 aa, Artificial Sequence
  Chemically synthesized
KKRNFDEIDRSSMPFPYATKRFYHLSSFDKKR

SEQ ID NO: 396 - protein, 46 aa, Artificial Sequence
  Chemically synthesized
KKRKNIKLFLNIINSNEYINVNKIFHGKCIYELPFYVNKERIKKKR

SEQ ID NO: 397 - protein, 26 aa, Artificial Sequence
  Chemically synthesized
KKRKAMVEELIKRGYAPDPIADWKKR

SEQ ID NO: 398 - protein, 44 aa, Artificial Sequence
  Chemically synthesized
KKRRGRKPKKKDDPKMELKDEVKDLKDFVVEESTSASSSAPKKR

SEQ ID NO: 399 - protein, 32 aa, Artificial Sequence
  Chemically synthesized
KKRLEKENRKIKEEDDEDSDDEDDEKAKKKKR

SEQ ID NO: 400 - protein, 44 aa, Artificial Sequence
  Chemically synthesized
KKRKRGPKKKKFKPEVAGKAAETENDDVAAAPEEADPIAEAKKR

SEQ ID NO: 401 - protein, 46 aa, Artificial Sequence
  Chemically synthesized
KKRKITDEKDAQHVPAEKREKVENWLKKSTEKPTSSQSDAEKKKKR

SEQ ID NO: 402 - protein, 29 aa, Artificial Sequence
  Chemically synthesized
KKRDDNKDKEGSSMDKLREESRRQYLKKR

SEQ ID NO: 403 - protein, 35 aa, Artificial Sequence
  Chemically synthesized
KKRVTSKSRTKRVKMFKQCQWVDADNQRDIKRKKR

SEQ ID NO: 404 - protein, 38 aa, Artificial Sequence
  Chemically synthesized
KKRMTEKDISSSESSISESKSLNCSASNQNENEKRKKR

SEQ ID NO: 405 - protein, 35 aa, Artificial Sequence; identical to SEQ ID NO: 403
  Chemically synthesized

SEQ ID NO: 406 - protein, 38 aa, Artificial Sequence; identical to SEQ ID NO: 404
  Chemically synthesized

SEQ ID NO: 407 - protein, 35 aa, Artificial Sequence; identical to SEQ ID NO: 403
  Chemically synthesized

SEQ ID NO: 408 - protein, 38 aa, Artificial Sequence; identical to SEQ ID NO: 404
  Chemically synthesized

SEQ ID NO: 409 - protein, 35 aa, Artificial Sequence; identical to SEQ ID NO: 403
  Chemically synthesized

SEQ ID NO: 410 - protein, 38 aa, Artificial Sequence; identical to SEQ ID NO: 404
  Chemically synthesized

SEQ ID NO: 411 - protein, 34 aa, Artificial Sequence
  Chemically synthesized
KKRGRPKKPKDENESDYNNTSFSDSNTDGTPKKR

SEQ ID NO: 412 - protein, 30 aa, Artificial Sequence
  Chemically synthesized
KKRGRPSKASVGGKSSTAAVAAISPGIKKR

SEQ ID NO: 413 - protein, 32 aa, Artificial Sequence
  Chemically synthesized
KKRANRKKANNNKKRASNNRKKANNNNNNKKR

SEQ ID NO: 414 - protein, 41 aa, Artificial Sequence
  Chemically synthesized
KKRDWYIQPTCARSGDGLYQGLDWLSDYIFDKKNKKKGKKR

SEQ ID NO: 415 - protein, 35 aa, Artificial Sequence
  Chemically synthesized
KKRHLEDSLDMLNEEIVKLRAAEEIRLTDQEDKKR

SEQ ID NO: 416 - protein, 35 aa, Artificial Sequence
  Chemically synthesized
KKRNNVFLTITDVIGRVVVSQSAGSCKITTKKKKR

SEQ ID NO: 417 - protein, 44 aa, Artificial Sequence
  Chemically synthesized
KKRYYLFFSKKRNNVFLTITDVIGRVVVSQSAGSCKITTKKKKR

SEQ ID NO: 418 - protein, 37 aa, Artificial Sequence
  Chemically synthesized
KKREIEIQQQLELQEETTLEIRERNVSLEQEVELKKR

SEQ ID NO: 419 - protein, 43 aa, Artificial Sequence
  Chemically synthesized
KKRWFILKGGDLSYYKTKGELVPLGVIHLNTSGHIKNSDRKKR

SEQ ID NO: 420 - protein, 45 aa, Artificial Sequence
  Chemically synthesized
KKRPNRLIIDQSDNDDNSMVMLSQAKMDELGLFRGDSVILKGKKR

SEQ ID NO: 421 - protein, 31 aa, Artificial Sequence
  Chemically synthesized
KKRKGKGKKRGKGRRRGSKGRKKKKGKGKKR

SEQ ID NO: 422 - protein, 35 aa, Artificial Sequence
  Chemically synthesized
KKRARSPSKKARRRSRSTKKTAAKRRKRSSSPKKR

SEQ ID NO: 423 - protein, 26 aa, Artificial Sequence
  Chemically synthesized
KKREAEKKKCAKLAKKEKEAAEKKKR

SEQ ID NO: 424 - protein, 27 aa, Artificial Sequence
  Chemically synthesized
KKRCKDLAKNKKKGHKKKGRNENRKKR

SEQ ID NO: 425 - protein, 35 aa, Artificial Sequence
  Chemically synthesized
KKRKEAAEKKKCEKAAKKRKEAAEKKKCEKSAKKR

SEQ ID NO: 426 - protein, 35 aa, Artificial Sequence
  Chemically synthesized
KKRKEEAEKKKCEKTAKKRKEAAEKKKCEKAAKKR

SEQ ID NO: 427 - protein, 35 aa, Artificial Sequence
  Chemically synthesized
KKRKEAAEKKKCEKAAKKRKEEAEKKKCEKTAKKR

SEQ ID NO: 428 - protein, 35 aa, Artificial Sequence
  Chemically synthesized
KKRKEEAEKKKCEKTAKKRKETAEKKKCEKAAKKR

SEQ ID NO: 429 - protein, 35 aa, Artificial Sequence
  Chemically synthesized
KKRKETAEKKKCEKAAKKRKQAAEKKKCEKAAKKR

SEQ ID NO: 430 - protein, 29 aa, Artificial Sequence
  Chemically synthesized
KKRGSKTSELKQNETTDAVVVNNEKVKKR

SEQ ID NO: 431 - protein, 26 aa, Artificial Sequence
  Chemically synthesized
KKRKSAIDVLKMPLFDILRSSPPKKR

SEQ ID NO: 432 - protein, 42 aa, Artificial Sequence
  Chemically synthesized
KKRFNLNLEEARQAFQTFKPDWNKIRYDAMKMQTSLGQMKKR

SEQ ID NO: 433 - protein, 38 aa, Artificial Sequence
  Chemically synthesized
KKRSDKRARSESKSRSRSGGRRSRSNSPPNRSPSPKKR

SEQ ID NO: 434 - protein, 34 aa, Artificial Sequence
  Chemically synthesized
KKRGVVLKPSVDEETDRRRMLNRIAAVRYREKKR

SEQ ID NO: 435 - protein, 36 aa, Artificial Sequence
  Chemically synthesized
KKRFHEMAEKDKQRYEAEMQNYVPPKGAVVGRGKKR

SEQ ID NO: 436 - protein, 36 aa, Artificial Sequence
  Chemically synthesized
KKRQHSSRSNESVSSSTSTEKSHKKTKKTKMKEKKR

SEQ ID NO: 437 - protein, 37 aa, Artificial Sequence; identical to SEQ ID NO: 418
  Chemically synthesized

SEQ ID NO: 438 - protein, 30 aa, Artificial Sequence
  Chemically synthesized
KKRMDDFVSQVGEDRLATYKPFTEDPSKKR

SEQ ID NO: 439 - protein, 28 aa, Artificial Sequence
  Chemically synthesized
KKRSKKRNSIDSGRKDKSKKRKSKKKKR

SEQ ID NO: 440 - protein, 31 aa, Artificial Sequence
  Chemically synthesized
KKRDSKNRRSHSKSDENEEGEEDDEERRKKR

SEQ ID NO: 441 - protein, 42 aa, Artificial Sequence
  Chemically synthesized
KKRLFEDFTNLYIEDDCLLSCSFSFFIYNKSIHLHFNVDKKR

SEQ ID NO: 442 - protein, 26 aa, Artificial Sequence
  Chemically synthesized
KKRIPNATEEEIEILEGMLCWNPKKR

SEQ ID NO: 443 - protein, 46 aa, Artificial Sequence
  Chemically synthesized
KKRKKDRDHNNNNNNNNNNNNNNNEQTSDSSDSSDSDSESRSKKKR

SEQ ID NO: 444 - protein, 26 aa, Artificial Sequence
  Chemically synthesized
KKRAAEQKIIDDEKARLKSIENSKKR

SEQ ID NO: 445 - protein, 38 aa, Artificial Sequence
  Chemically synthesized
KKRKCNFSSPLLFSPFKYGVTSPFSPSKMKLKSPFKKR

SEQ ID NO: 446 - protein, 36 aa, Artificial Sequence
  Chemically synthesized
KKRLKREKRLKEKQDLLLIKLEKQKEKQLEEQMKKR

SEQ ID NO: 447 - protein, 27 aa, Artificial Sequence
  Chemically synthesized
KKRIKFTHMVGRGQYGKVYDALYDKKR

SEQ ID NO: 448 - protein, 35 aa, Artificial Sequence
  Chemically synthesized
KKRREKEARKMKRAGGRFKSRATGANAEEKRAKKR

SEQ ID NO: 449 - protein, 39 aa, Artificial Sequence
  Chemically synthesized
KKRLQKEEQDRLAAAELERKRLEKEAEEKRIAQELEKKR

SEQ ID NO: 450 - protein, 31 aa, Artificial Sequence
  Chemically synthesized
KKRKITSSEYGMSLEFFKKNPKKVVQNLKKR

SEQ ID NO: 451 - protein, 41 aa, Artificial Sequence
  Chemically synthesized
KKRDLIKNNKLIHNVDVNYINMITNDNHISSEKCRDIKKKR

SEQ ID NO: 452 - protein, 46 aa, Artificial Sequence
  Chemically synthesized
KKRIYGYLFYTTLLKNITSLNNLFVHYILNNYFFFHSKSMYMLKKR

SEQ ID NO: 453 - protein, 31 aa, Artificial Sequence
  Chemically synthesized
KKRIFIYENTVYYTPDDCVFCTQLNCTIKKR

SEQ ID NO: 454 - protein, 44 aa, Artificial Sequence
  Chemically synthesized
KKRRNEETRSARSVGIAAADARQAAIVAEKTSGPSLLEIHQKKR

SEQ ID NO: 455 - protein, 39 aa, Artificial Sequence
  Chemically synthesized
KKRPGTTSKKSIATVTASPEMSSKTTQMEPEQDGEGKKR

SEQ ID NO: 456 - protein, 29 aa, Artificial Sequence
  Chemically synthesized
KKRLARGGHVEDPTADPLDISLPSSKKKR

SEQ ID NO: 457 - protein, 27 aa, Artificial Sequence
  Chemically synthesized
KKRSDESDDDNIGLVARGSPRFFGKKR

SEQ ID NO: 458 - protein, 45 aa, Artificial Sequence
  Chemically synthesized
KKRADDEDILLGERGSPRFFGKKRANDENISFSLRGSPRFFGKKR

SEQ ID NO: 459 - protein, 46 aa, Artificial Sequence
  Chemically synthesized
KKRSDDNVALDLRGSPRFFGKRQSSDLDDEISVALRGSPRFFGKKR

SEQ ID NO: 460 - protein, 34 aa, Artificial Sequence
  Chemically synthesized
KKRTEDGRPTLSAHPARFSPEDKYSRQRLTIKKR

SEQ ID NO: 461 - protein, 32 aa, Artificial Sequence
  Chemically synthesized
KKRRVEKKKSKTKWTERKQKVEHDKEKRQKKR

SEQ ID NO: 462 - protein, 37 aa, Artificial Sequence
  Chemically synthesized
KKRPRQPRKRIVMVEEVKRKIRTPIKEEEEVQERKKR

SEQ ID NO: 463 - protein, 33 aa, Artificial Sequence
  Chemically synthesized
KKRVQILYIESESEDEDEQDSHDKSLDSPEKKR

SEQ ID NO: 464 - protein, 34 aa, Artificial Sequence
  Chemically synthesized
KKRKRGVVNTKAYKETKPAVKKETKATPALHKKR

SEQ ID NO: 465 - protein, 40 aa, Artificial Sequence
  Chemically synthesized
KKRKCVITLDEKQVESKRLKKEESNVEATSRPPAQSPKKR

SEQ ID NO: 466 - protein, 37 aa, Artificial Sequence
  Chemically synthesized
KKRKKPQTAAKSSSRSDSDSDWANNKAGAPSSKKKKR

SEQ ID NO: 467 - protein, 39 aa, Artificial Sequence
  Chemically synthesized
KKRKRKEEGEKEKKPRKKVPKQLGVMALNSHKSEKKKKR

SEQ ID NO: 468 - protein, 33 aa, Artificial Sequence
  Chemically synthesized
KKRKKVSGPNPLSCLKKKKKTQDTNSSASEKKR

SEQ ID NO: 469 - protein, 33 aa, Artificial Sequence; identical to SEQ ID NO: 351
  Chemically synthesized

SEQ ID NO: 470 - protein, 40 aa, Artificial Sequence
  Chemically synthesized
KKRLEDEQEMVRMVRAATLIQALWKGYLVRSMLKSKKKKR

SEQ ID NO: 471 - protein, 32 aa, Artificial Sequence
  Chemically synthesized
KKRSREDVGDNDDTEGAIGVRNKVAGGKMKKR

SEQ ID NO: 472 - protein, 39 aa, Artificial Sequence
  Chemically synthesized
KKREEMEEENRKIIEFAKLQQQREEDRMAKVQEKVKKKR

SEQ ID NO: 473 - protein, 31 aa, Artificial Sequence
  Chemically synthesized
KKRRQYQEEEVLDGPGVNTAQKAKKKKQKKR

SEQ ID NO: 474 - protein, 37 aa, Artificial Sequence
  Chemically synthesized
KKRKQKEEEEPTTTERSAEKYSEHTDESIRKSKKKKR

SEQ ID NO: 475 - protein, 41 aa, Artificial Sequence
  Chemically synthesized
KKREGSSAQAPASKKPKEEIPVIPKGKPKSGRVWKDRSKKR

SEQ ID NO: 476 - protein, 26 aa, Artificial Sequence
  Chemically synthesized
KKRKLDPEIVPEEKDCGDDEGNSKKR

SEQ ID NO: 477 - protein, 39 aa, Artificial Sequence
  Chemically synthesized
KKRMEAEQEMVRMVRAATLIQAFWKGYLVRSLLRSKKKR

SEQ ID NO: 478 - protein, 45 aa, Artificial Sequence
  Chemically synthesized
KKRSTSVMSFFSKVSWNLRLQKQEPLKNVFFILAETARDPSVKKR

SEQ ID NO: 479 - protein, 41 aa, Artificial Sequence
  Chemically synthesized
KKRHKKEKRKKEKDRGRRLDSSLAPAPIQHDSDSSTCCKKR

SEQ ID NO: 480 - protein, 40 aa, Artificial Sequence
  Chemically synthesized
KKRIERFYHCLQHALEKETVSTTSQPKEKVNTSYIRKKKR

SEQ ID NO: 481 - protein, 33 aa, Artificial Sequence; identical to SEQ ID NO: 351
  Chemically synthesized

SEQ ID NO: 482 - protein, 27 aa, Artificial Sequence
  Chemically synthesized
KKRKERFGIVTSSAGTGTTEDTEAKKR

SEQ ID NO: 483 - protein, 29 aa, Artificial Sequence
  Chemically synthesized
KKRKKGEKQIPGEEKGRKRRRVKEDKKKR

SEQ ID NO: 484 - protein, 42 aa, Artificial Sequence
  Chemically synthesized
KKRKGSSSLAPASKKLNKEELPVIPKGKPKSGRVWKDRSKKR

SEQ ID NO: 485 - protein, 45 aa, Artificial Sequence; identical to SEQ ID NO: 341
  Chemically synthesized

SEQ ID NO: 486 - protein, 35 aa, Artificial Sequence
  Chemically synthesized
KKRKDEGKSRTTPPERPLTEVKAETRAEEAPEKKR

SEQ ID NO: 487 - protein, 35 aa, Artificial Sequence
  Chemically synthesized
KKRKEEGKSRTTPPERPLTEVKAETRAEEAPEKKR

SEQ ID NO: 488 - protein, 35 aa, Artificial Sequence; identical to SEQ ID NO: 346
  Chemically synthesized

SEQ ID NO: 489 - protein, 35 aa, Artificial Sequence; identical to SEQ ID NO: 346
  Chemically synthesized

SEQ ID NO: 490 - protein, 35 aa, Artificial Sequence; identical to SEQ ID NO: 373
  Chemically synthesized

SEQ ID NO: 491 - protein, 43 aa, Artificial Sequence
  Chemically synthesized
KKRKALEAKKEEEEIQREMVKLRREIIERRRTVKEAWKIEKKR

SEQ ID NO: 492 - protein, 41 aa, Artificial Sequence; identical to SEQ ID NO: 347
  Chemically synthesized

SEQ ID NO: 493 - protein, 37 aa, Artificial Sequence
  Chemically synthesized
KKRILESHNNTLVDPCEEHKKKNPDASVKFSEFLKKR

SEQ ID NO: 494 - protein, 34 aa, Artificial Sequence
  Chemically synthesized
KKRLRMLAVLGVELVFMLAVILGVLLGAHTHKKR

SEQ ID NO: 495 - protein, 37 aa, Artificial Sequence
  Chemically synthesized
KKRKRGDDDYALPGDGDLVVECEEEGEKGEKRVKKKR

SEQ ID NO: 496 - protein, 40 aa, Artificial Sequence
  Chemically synthesized
KKRKKRKRGDDDYALPGDGDLVVECEEEGEKGEKRVKKKR

SEQ ID NO: 497 - protein, 43 aa, Artificial Sequence
  Chemically synthesized
KKRKRGDDDYALPGDGDLVVECEEEGEKGEKRVKKKRRSRKKR

SEQ ID NO: 498 - protein, 46 aa, Artificial Sequence
  Chemically synthesized
KKRKKRKRGDDDYALPGDGDLVVECEEEGEKGEKRVKKKRRSRKKR

SEQ ID NO: 499 - protein, 37 aa, Artificial Sequence; identical to SEQ ID NO: 495
  Chemically synthesized

SEQ ID NO: 500 - protein, 40 aa, Artificial Sequence; identical to SEQ ID NO: 496
  Chemically synthesized

SEQ ID NO: 501 - protein, 43 aa, Artificial Sequence; identical to SEQ ID NO: 497
  Chemically synthesized

SEQ ID NO: 502 - protein, 46 aa, Artificial Sequence; identical to SEQ ID NO: 498
  Chemically synthesized

SEQ ID NO: 503 - protein, 28 aa, Artificial Sequence
  Chemically synthesized
KKRNPESALLNQEKNIEENYAESTIKKR

SEQ ID NO: 504 - protein, 28 aa, Artificial Sequence
  Chemically synthesized
KKRNPESALSNQEKNIEKNYAESKIKKR

SEQ ID NO: 505 - protein, 45 aa, Artificial Sequence
  Chemically synthesized
KKRDKGEKKDFCFLTVWGMETELPFGSAQKKPSFFEPISKELKKR

SEQ ID NO: 506 - protein, 28 aa, Artificial Sequence
  Chemically synthesized
KKRNPESALLNQEKNIEENFAESMIKKR

SEQ ID NO: 507 - protein, 31 aa, Artificial Sequence
  Chemically synthesized
KKRQDKKNPGSDAQNQKDVEEDSTRSDSKKR

SEQ ID NO: 508 - protein, 28 aa, Artificial Sequence
  Chemically synthesized
KKRKKKDEGLDEDDYLLLQDNNVKFKKR

SEQ ID NO: 509 - protein, 27 aa, Artificial Sequence
  Chemically synthesized
KKRKSLERYGSITSAVSDDKGDTTKKR

SEQ ID NO: 510 - protein, 39 aa, Artificial Sequence
  Chemically synthesized
KKRHYGGESSLAGTQSSIIMRTAAEMLAVYQACGIKKKR

SEQ ID NO: 511 - protein, 36 aa, Artificial Sequence
  Chemically synthesized
KKRGRNIDDAEEVENELKRVEDELYKIPDHLKVKKR

SEQ ID NO: 512 - protein, 27 aa, Artificial Sequence
  Chemically synthesized
KKREEEAEQARKREEEREKEEEMAKKR

SEQ ID NO: 513 - protein, 32 aa, Artificial Sequence
  Chemically synthesized
KKREEEEARKREEERKREEEEAKRREEERKKR

SEQ ID NO: 514 - protein, 44 aa, Artificial Sequence
  Chemically synthesized
KKRRGRPRKYGPDSGEMSLGLNPGAPSFTVSQPSSGGDGGEKKR

SEQ ID NO: 515 - protein, 34 aa, Artificial Sequence
  Chemically synthesized
KKRQDFVKDRRWIKREYDEFKVRINGLPEQIKKR

SEQ ID NO: 516 - protein, 44 aa, Artificial Sequence
  Chemically synthesized
KKRKLETCDETWKREVVQAEEAKGGGEQKSESKKAKKQDKEKKR

SEQ ID NO: 517 - protein, 30 aa, Artificial Sequence
  Chemically synthesized
KKRKPREWWKEEFCEELTRKKRKKKKKKKR

SEQ ID NO: 518 - protein, 37 aa, Artificial Sequence
  Chemically synthesized
KKRGLSSISSIDSWFHRDDGASSVHDHNLNPTKRKKR

SEQ ID NO: 519 - protein, 45 aa, Artificial Sequence
  Chemically synthesized
KKRKKKKKKKRGLSSISSIDSWFHRDDGASSVHDHNLNPTKRKKR

SEQ ID NO: 520 - protein, 27 aa, Artificial Sequence
  Chemically synthesized
KKRRRATKKPYSRSIVGATLEVIQKKR

SEQ ID NO: 521 - protein, 37 aa, Artificial Sequence
  Chemically synthesized
KKRVDSVVIGRSSKARRGHREPRKARSSGRLEAEKKR

SEQ ID NO: 522 - protein, 45 aa, Artificial Sequence
  Chemically synthesized
KKRNKKFTISIKLFKKFYKNKLNENGEYKIESQILQNEKELNKKR

SEQ ID NO: 523 - protein, 39 aa, Artificial Sequence
  Chemically synthesized
KKRIYLISDRNPSTGETGWYDKDKGRESKKGIWQIFKKR

SEQ ID NO: 524 - protein, 37 aa, Artificial Sequence
  Chemically synthesized
KKRIAKAKSEAAEYQKLLASRLKEQREKRSESLAKKR

SEQ ID NO: 525 - protein, 27 aa, Artificial Sequence
  Chemically synthesized
KKRRRTTKKPYSRSIVGATLEVIQKKR

SEQ ID NO: 526 - protein, 45 aa, Artificial Sequence
  Chemically synthesized
KKRRAKVFKLAKGFKGAHNSLFRTAKQQVLKALRYSYVGRKRKKR

SEQ ID NO: 527 - protein, 37 aa, Artificial Sequence
  Chemically synthesized
KKRIAKANSDAADYQKLLASRLKEQRDRRSESLAKKR

SEQ ID NO: 528 - protein, 29 aa, Artificial Sequence
  Chemically synthesized
KKRFLDEMNKKKSCLKMVAQFFFQFKKKR

SEQ ID NO: 529 - protein, 43 aa, Artificial Sequence
  Chemically synthesized
KKRTNLKKGPQSKLTKKKKERKVDKTRAIINEIERVLKEKKKR

SEQ ID NO: 530 - protein, 46 aa, Artificial Sequence
  Chemically synthesized
KKRFLDEMNKKKSCLKMVAQFFFQFKKKRKNKKIDKAIKGINKKKR

SEQ ID NO: 531 - protein, 32 aa, Artificial Sequence
  Chemically synthesized
KKRNKMQDLTNRANKARNEIERIRKEKKKKKR

SEQ ID NO: 532 - protein, 34 aa, Artificial Sequence
  Chemically synthesized
KKRASVRKICQKCRLTRRRGRIRVICSNPRHKKR

SEQ ID NO: 533 - protein, 29 aa, Artificial Sequence
  Chemically synthesized
KKRRTLQEWQIQPKKYLLEKHNIKVLKKR

SEQ ID NO: 534 - protein, 45 aa, Artificial Sequence
  Chemically synthesized
KKRRAKIFKLAKGFKGAHKCLFRTAKQQVLKALRYSYVGRKRKKR

SEQ ID NO: 535 - protein, 46 aa, Artificial Sequence
  Chemically synthesized
KKRLTAAQVLEHTWILNAKKAPNVSLGETVKARLKQFSVMNKLKKR

SEQ ID NO: 536 - protein, 29 aa, Artificial Sequence
  Chemically synthesized
KKRLTLKHRIEIVMGIICMIVAGFQEKKR

SEQ ID NO: 537 - protein, 28 aa, Artificial Sequence
  Chemically synthesized
KKRIDNFKKEALLKANPQIQANPQLKKR

SEQ ID NO: 538 - protein, 46 aa, Artificial Sequence
  Chemically synthesized
KKRLSAAQVLEHSWIQNAKKAPNVSLGETVKARLKQFSVMNKLKKR

SEQ ID NO: 539 - protein, 28 aa, Artificial Sequence
  Chemically synthesized
KKRRGRPRKYEANGAPLPSSSVPLVKKR

SEQ ID NO: 540 - protein, 36 aa, Artificial Sequence
  Chemically synthesized
KKRGYNGKVIALIVALSTVISIMLVLLFLFMMYKKR

SEQ ID NO: 541 - protein, 27 aa, Artificial Sequence
  Chemically synthesized
KKRDASFVQPDERTAQTFSTKNKEKKR

SEQ ID NO: 542 - protein, 33 aa, Artificial Sequence
  Chemically synthesized
KKRKLEAEAEVVVVEAAAATSTDEATKSSKKKR

SEQ ID NO: 543 - protein, 46 aa, Artificial Sequence
  Chemically synthesized
KKRSRATSTDKNKRARVNKRAQKNVEMSGDNNEGEEEEGETKLKKR

SEQ ID NO: 544 - protein, 27 aa, Artificial Sequence
  Chemically synthesized
KKRVSDESDSDSDSGDRKRRRRSMKKR

SEQ ID NO: 545 - protein, 45 aa, Artificial Sequence
  Chemically synthesized
KKRKRSKPLRPAPSRVLRSTSEKKNKAHNELLNDGAGVQPAEKKR

SEQ ID NO: 546 - protein, 26 aa, Artificial Sequence
  Chemically synthesized
KKRKRSSKKDKHRRSKQRDKRHEKKR

SEQ ID NO: 547 - protein, 44 aa, Artificial Sequence
  Chemically synthesized
KKRSMRDKRPKRKSRRSPDSLEDSNSGSEASLSDVNVEIGAKKR

SEQ ID NO: 548 - protein, 41 aa, Artificial Sequence
  Chemically synthesized
KKRKSKKNKRHKKHSSRTVEETDESSTGSEDSREKRGSKKR

SEQ ID NO: 549 - protein, 40 aa, Artificial Sequence
  Chemically synthesized
KKREEQLEKARLAMERKRKLHEKAAAKAVIRVKKEAEKKR

SEQ ID NO: 550 - protein, 34 aa, Artificial Sequence
  Chemically synthesized
KKRLRMLAVLGVELVFMLAVILGVLLSAHTHKKR

SEQ ID NO: 551 - protein, 44 aa, Artificial Sequence
  Chemically synthesized
KKRKGSETEGWENLPDDLSCSTASRSSNFRSHFSLEGYARLKKR

SEQ ID NO: 552 - protein, 41 aa, Artificial Sequence
  Chemically synthesized
KKRVYKDKSRCYECGDEGHLSYECPKNQLGPRERPPPPKKR

SEQ ID NO: 553 - protein, 29 aa, Artificial Sequence
  Chemically synthesized
KKRMEALNLPKLSQILNSTSVKISPMKKR

SEQ ID NO: 554 - protein, 30 aa, Artificial Sequence
  Chemically synthesized
KKRSIPRTPEKKMVDVKRVHIQRRGVGKKR

SEQ ID NO: 555 - protein, 26 aa, Artificial Sequence
  Chemically synthesized
KKRVKTQCVIKSSDKSDHDTLLKKKR

SEQ ID NO: 556 - protein, 27 aa, Artificial Sequence
  Chemically synthesized
KKRVYRLVKASDVKSKEHVKNKSGKKR

SEQ ID NO: 557 - protein, 27 aa, Artificial Sequence
  Chemically synthesized
KKRPGVSPGDRSGGKGRPTSRMGNKKR

SEQ ID NO: 558 - protein, 36 aa, Artificial Sequence
  Chemically synthesized
KKRNTCSVSSQTRKVSLKISKINGVGVRCTPNSKKR

SEQ ID NO: 559 - protein, 37 aa, Artificial Sequence
  Chemically synthesized
KKRQDKLEMSEIKQFFDRPIMKAAKELNVGLTVLKKR

SEQ ID NO: 560 - protein, 43 aa, Artificial Sequence
  Chemically synthesized
KKRNLKKKRQDKLEMSEIKQFFDRPIMKAAKELNVGLTVLKKR

SEQ ID NO: 561 - protein, 29 aa, Artificial Sequence
  Chemically synthesized
KKRKLYDAMKISQSRKRSGVEIIEQRKKR

SEQ ID NO: 562 - protein, 36 aa, Artificial Sequence
  Chemically synthesized
KKRGYNSQVLALIVALSGVTVILLALLFFFVMYKKR

SEQ ID NO: 563 - protein, 39 aa, Artificial Sequence
  Chemically synthesized
KKRQPEFRMLGKDHLSDQESVEVRVPDSIKKPIDSSKKR

SEQ ID NO: 564 - protein, 37 aa, Artificial Sequence
  Chemically synthesized
KKRVAKAKSEAAEYQKLLASRLKEQRDRRSESLAKKR

SEQ ID NO: 565 - protein, 29 aa, Artificial Sequence
  Chemically synthesized
KKRKEETVLLPSGVQGLGMGLPDMRSKKR

SEQ ID NO: 566 - protein, 39 aa, Artificial Sequence
  Chemically synthesized
KKRVKKLKSKKLEAEEELNNVQEIDAHDIVMEQKSDKKR

SEQ ID NO: 567 - protein, 38 aa, Artificial Sequence
  Chemically synthesized
KKRKKTPNGDPQRLGIDTLLPQCLRGAPAAARRKRKKR

SEQ ID NO: 568 - protein, 36 aa, Artificial Sequence
  Chemically synthesized
KKRRAPPPPSPGLLGQDKVSEKASLSSQADLQKKKR

SEQ ID NO: 569 - protein, 39 aa, Artificial Sequence; identical to SEQ ID NO: 365
  Chemically synthesized

SEQ ID NO: 570 - protein, 42 aa, Artificial Sequence
  Chemically synthesized
KKRMRLEEENEGLRQRLIETELAKQVLQTELDRPREHSLKKR

SEQ ID NO: 571 - protein, 33 aa, Artificial Sequence
  Chemically synthesized
KKRAKMGKLKDKFKTELESTSEILGFDVKTKKR

SEQ ID NO: 572 - protein, 45 aa, Artificial Sequence
  Chemically synthesized
KKRKKLKSEGTTSEKKAASQQDAVTEGAMPAATGKDQPPSTGKKR

SEQ ID NO: 573 - protein, 33 aa, Artificial Sequence
  Chemically synthesized
KKRKEEERKKKETDQKKEAAVSVQEESDLEKKR

SEQ ID NO: 574 - protein, 29 aa, Artificial Sequence
  Chemically synthesized
KKRKKGEKQAPGEEKGRKRRRVKEDKKKR

SEQ ID NO: 575 - protein, 36 aa, Artificial Sequence
  Chemically synthesized
KKRSFSGFGSPLDRLSAGSVEHRGKQRKAVDHSKKR

SEQ ID NO: 576 - protein, 36 aa, Artificial Sequence
  Chemically synthesized
KKRSFSGFGSPLDRLSAGSVEHRGKQRRVVDHSKKR

SEQ ID NO: 577 - protein, 27 aa, Artificial Sequence
  Chemically synthesized
KKRVGDSSALQTIHGKEMSKIARKKKR

SEQ ID NO: 578 - protein, 27 aa, Artificial Sequence
  Chemically synthesized
KKRVGDSSALQTIHGKEMSKIARKKKR

SEQ ID NO: 579 - protein, 41 aa, Artificial Sequence; identical to SEQ ID NO: 347
  Chemically synthesized

SEQ ID NO: 580 - protein, 39 aa, Artificial Sequence
  Chemically synthesized
KKRDKVEASSLPEARAGKRERCSAEDEDCLPPRPKAKKR

SEQ ID NO: 581 - protein, 45 aa, Artificial Sequence
  Chemically synthesized
KKRRKKSSGERLKEEKPKKSKTAAASKTKGKSKLNTITPVVGKKR

SEQ ID NO: 582 - protein, 39 aa, Artificial Sequence
  Chemically synthesized
KKRKQKEGEEAATTEKSLGDELLGHTDRSFRDSRKKKKR

SEQ ID NO: 583 - protein, 44 aa, Artificial Sequence
  Chemically synthesized
KKRQKAERQGTAIGSEEEEAAGESGPRELSTEQSDQPSRKKKKR

SEQ ID NO: 584 - protein, 46 aa, Artificial Sequence
  Chemically synthesized
KKRRKQRHEEDGEMGVCDEGGRDVTSRPKAVNSGGDKDPRRSSKKR

SEQ ID NO: 585 - protein, 33 aa, Artificial Sequence
  Chemically synthesized
KKRTKMGKLKDKFKTELESTSEIIGFDVKTKKR

SEQ ID NO: 586 - protein, 45 aa, Artificial Sequence
  Chemically synthesized
KKREQTASAPATPLVSKHRPSFTRSNTISKPYISNTLPSDAPKKR

SEQ ID NO: 587 - protein, 27 aa, Artificial Sequence
  Chemically synthesized
KKRKERFGIVTSSAGTGTTEDTEAKKR

SEQ ID NO: 588 - protein, 42 aa, Artificial Sequence
  Chemically synthesized
KKRPKGYVQTRTGRTSLKNSSETVGQKRKKAEETKGLPPKKR

SEQ ID NO: 589 - protein, 33 aa, Artificial Sequence
  Chemically synthesized
KKRQRLIDVQDELIRLEPQLKQLQTKYDDLKKR

SEQ ID NO: 590 - protein, 45 aa, Artificial Sequence
  Chemically synthesized
KKRKMYEDKPLSSESLSESDCGEVQAKKKKSGEERERTTDKAKKR

SEQ ID NO: 591 - protein, 31 aa, Artificial Sequence
  Chemically synthesized
KKRVKQFKNKPQGGKGPKDKFQKANKFNKKR

SEQ ID NO: 592 - protein, 36 aa, Artificial Sequence
  Chemically synthesized
KKRQTCEEDLDTQDEEDKDDLTKKERKVRKKDKKKR

SEQ ID NO: 593 - protein, 44 aa, Artificial Sequence
  Chemically synthesized
KKRQQYCEEVLDVSNKDDGRTWEAEDGGERSQPHPKARAKKKKR

SEQ ID NO: 594 - protein, 46 aa, Artificial Sequence
  Chemically synthesized
KKRRRRHHEEEEEMGVCDEGGRDVTGGPKAVNSGADTDPWRSSKKR

SEQ ID NO: 595 - protein, 46 aa, Artificial Sequence
  Chemically synthesized
KKRSSIWQFFSRLFSSSSNATKKPEPPVNLKYNAPTSHVTPSVKKR

SEQ ID NO: 596 - protein, 36 aa, Artificial Sequence
  Chemically synthesized
KKRRAPPPPSPKLLGQDKVSEKASLSSQADLQKKKR

SEQ ID NO: 597 - protein, 32 aa, Artificial Sequence
  Chemically synthesized
KKRKALEFVTNPDIAAKKKLKKHKNKSEAKKR

SEQ ID NO: 598 - protein, 39 aa, Artificial Sequence
  Chemically synthesized
KKRDKVETGGLPESKAGKRERSSAEDEDCLPPRPKLKKR

SEQ ID NO: 599 - protein, 41 aa, Artificial Sequence
  Chemically synthesized
KKRVIASPQAPASKKLKEELPVIPKGKPKSGRVWKDRSKKR

SEQ ID NO: 600 - protein, 40 aa, Artificial Sequence
  Chemically synthesized
KKRVEAEREMVRMVRAATLIQAMWKGYLVRSMLRSRKKKR

SEQ ID NO: 601 - protein, 27 aa, Artificial Sequence
  Chemically synthesized
KKRSLKLTEGKSLVDGNGEKPVMKKKR

SEQ ID NO: 602 - protein, 28 aa, Artificial Sequence
  Chemically synthesized
KKRRRRPPKGEEGSEEEETENGPKPKKR

SEQ ID NO: 603 - protein, 37 aa, Artificial Sequence
  Chemically synthesized
KKRGGGGGRRSKKGGEFDEFVNDDTDDDLPVSKKKKR

SEQ ID NO: 604 - protein, 28 aa, Artificial Sequence
  Chemically synthesized
KKRRREPQTPAQETLESEWPQKAKKKKR

SEQ ID NO: 605 - protein, 33 aa, Artificial Sequence; identical to SEQ ID NO: 573
  Chemically synthesized

SEQ ID NO: 606 - protein, 36 aa, Artificial Sequence
  Chemically synthesized
KKRSAGIIEDVGGEVQNMLEKFGADINKALLAKKKR

SEQ ID NO: 607 - protein, 45 aa, Artificial Sequence; identical to SEQ ID NO: 340
  Chemically synthesized

SEQ ID NO: 608 - protein, 31 aa, Artificial Sequence
  Chemically synthesized
KKRAATTVLQELKKLPPLPVIEKPKLFFKKR

SEQ ID NO: 609 - protein, 29 aa, Artificial Sequence
  Chemically synthesized
KKRKKGQEAGHEAGGEDAAEANGAPEKKR

SEQ ID NO: 610 - protein, 45 aa, Artificial Sequence; identical to SEQ ID NO: 340
  Chemically synthesized

SEQ ID NO: 611 - protein, 34 aa, Artificial Sequence
  Chemically synthesized
KKRKRYFMQEEMEAKTMEPVAELPVPSATSSKKR

SEQ ID NO: 612 - protein, 37 aa, Artificial Sequence
  Chemically synthesized
KKRKKSKGTETSQVEHTEPVAQTEPPEGTFLFPTKKR

SEQ ID NO: 613 - protein, 43 aa, Artificial Sequence
  Chemically synthesized
KKRKRQKEADGTEEVDGIVADSQPQVIVEAQEETILLSPTKKR

SEQ ID NO: 614 - protein, 31 aa, Artificial Sequence
  Chemically synthesized
KKRHQEDQDPIFQASDSSGYQSDHNKKKKKR

SEQ ID NO: 615 - protein, 45 aa, Artificial Sequence
  Chemically synthesized
KKRHQEDQDPIFQASDSSGYQSDHNKKKKKRKHSEEANFESPKKR

SEQ ID NO: 616 - protein, 45 aa, Artificial Sequence
  Chemically synthesized
KKRRTPLLSFLSKVSWKLRLQKRELLKNALFVLAERARDPNAKKR

SEQ ID NO: 617 - protein, 46 aa, Artificial Sequence
  Chemically synthesized
KKRKKLKSEGTTPEKNAASQQDAVTEGAMPAATGKDQPPSTGKKKR

SEQ ID NO: 618 - protein, 39 aa, Artificial Sequence; identical to SEQ ID NO: 365
  Chemically synthesized

SEQ ID NO: 619 - protein, 26 aa, Artificial Sequence
  Chemically synthesized
KKRLRNKRSRSRESSSRPRARKDKKR

SEQ ID NO: 620 - protein, 31 aa, Artificial Sequence
  Chemically synthesized
KKRREKAIGEGRVVYIRNLSGDMSSRELKKR

SEQ ID NO: 621 - protein, 35 aa, Artificial Sequence
  Chemically synthesized
KKRRRSPSYSPSPVKKKKKKSSKKHKRHRSFSKKR

SEQ ID NO: 622 - protein, 31 aa, Artificial Sequence; identical to SEQ ID NO: 383
  Chemically synthesized

SEQ ID NO: 623 - protein, 31 aa, Artificial Sequence
  Chemically synthesized
KKRGRTPKILIPHPTSTPSKSAEPLKFPKKR

SEQ ID NO: 624 - protein, 46 aa, Artificial Sequence
  Chemically synthesized
KKRLDGIEEVEREINRGRSCKGSEFTCPEDNKIRELTLEIERLKKR

SEQ ID NO: 625 - protein, 38 aa, Artificial Sequence
  Chemically synthesized
KKRFGGVQELLSQQKKSGEVAVLKRDGRYIYYLITKKR

SEQ ID NO: 626 - protein, 37 aa, Artificial Sequence
  Chemically synthesized
KKRLRRMTPFWRGVSLRPIGASCRDDSECITRLCKKR

SEQ ID NO: 627 - protein, 46 aa, Artificial Sequence
  Chemically synthesized
KKRLDGIEEVEREINRGRLCKGSEFTCPEDNKIRELTLEIERLKKR

SEQ ID NO: 628 - protein, 45 aa, Artificial Sequence
  Chemically synthesized
KKRKMYEDKPLSSESLSESDCGEVQAKRKKSGEERERTTDKAKKR

SEQ ID NO: 629 - protein, 32 aa, Artificial Sequence
  Chemically synthesized
KKRKREDAGDDDDKEGAIGVRNKVAGGKMKKR

SEQ ID NO: 630 - protein, 45 aa, Artificial Sequence
  Chemically synthesized
KKRDRAELQPGGPSEDECSDASVEAAEDCVQTPDIQDDVPKPKKR

SEQ ID NO: 631 - protein, 27 aa, Artificial Sequence
  Chemically synthesized
KKRKERFGIVTSSAGTGTTEDTEAKKR

SEQ ID NO: 632 - protein, 40 aa, Artificial Sequence
  Chemically synthesized
KKRVEAEREMVRMVRAATLIQAVWKGYLVRSILRSKKKKR

SEQ ID NO: 633 - protein, 35 aa, Artificial Sequence
  Chemically synthesized
KKRKLKADDTDNVYYNANRKNSKRLNVEVFIPKKR

SEQ ID NO: 634 - protein, 45 aa, Artificial Sequence; identical to SEQ ID NO: 581
  Chemically synthesized

SEQ ID NO: 635 - protein, 39 aa, Artificial Sequence
  Chemically synthesized
KKRKNISQDTFGTTFGRIHMQKQDLSKLQTRKMKGLKKR

SEQ ID NO: 636 - protein, 43 aa, Artificial Sequence
  Chemically synthesized
KKRVIASPQAPASKKLKEKEELPVIPKGKPKSGRVWKDRSKKR

SEQ ID NO: 637 - protein, 37 aa, Artificial Sequence
  Chemically synthesized
KKRQRSESHSASERSSSAESERSYKKSKKHKKKSKKR

SEQ ID NO: 638 - protein, 32 aa, Artificial Sequence
  Chemically synthesized
KKRQLLDSDEEEDDEGRRQAVSGTPRVHRKKR

SEQ ID NO: 639 - protein, 39 aa, Artificial Sequence; identical to SEQ ID NO: 389
  Chemically synthesized

SEQ ID NO: 640 - protein, 32 aa, Artificial Sequence
  Chemically synthesized
KKREAAEKEKRARIAKERAEKERLERQQEKKR

SEQ ID NO: 641 - protein, 41 aa, Artificial Sequence
  Chemically synthesized
KKRGRKPGSVVAAAAAEAKKKAVKESSIRSVHETVLPIKKR

SEQ ID NO: 642 - protein, 46 aa, Artificial Sequence
  Chemically synthesized
KKRKRCGVCVPCLRKEPCGACYNCVNRSTSHQICKMRKCEQLKKKR

SEQ ID NO: 643 - protein, 46 aa, Artificial Sequence; identical to SEQ ID NO: 642
  Chemically synthesized

SEQ ID NO: 644 - protein, 31 aa, Artificial Sequence
  Chemically synthesized
KKRKRSSTRKASDETDSESETDSRESFKKKR

SEQ ID NO: 645 - protein, 34 aa, Artificial Sequence
  Chemically synthesized
KKRKKKHPSKKERKGTIRDYECAETKQKKKHKKR

SEQ ID NO: 646 - protein, 26 aa, Artificial Sequence
  Chemically synthesized
KKRRREHGQLWFPEGFIPKEPSKKKR

SEQ ID NO: 647 - protein, 32 aa, Artificial Sequence
  Chemically synthesized
KKRMAAELYPVSDHATLQKSGAVMLSLPEKKR

SEQ ID NO: 648 - protein, 36 aa, Artificial Sequence
  Chemically synthesized
KKRRAPAPPPAPTQTLPPTSQISLGSPSSHNLLKKR

SEQ ID NO: 649 - protein, 31 aa, Artificial Sequence
  Chemically synthesized
KKRKHVKNEEDETNHEKTKQHLKEEKRRKKR

SEQ ID NO: 650 - protein, 46 aa, Artificial Sequence
  Chemically synthesized
KKRSSLFSPRKSRKNGNAAAESGRETGKHKSLWKTVFSVYKKDKKR

SEQ ID NO: 651 - protein, 46 aa, Artificial Sequence
  Chemically synthesized
KKRKRCGVCVPCLRKEPCGTCYNCVNRSTSHQICKMRKCEQLKKKR

SEQ ID NO: 652 - protein, 27 aa, Artificial Sequence
  Chemically synthesized
KKRGLKPSGKRELAHPPSSEPPLPKKR

SEQ ID NO: 653 - protein, 33 aa, Artificial Sequence
  Chemically synthesized
KKRKRHRSASRKGRHSGSSSRRKRKEDKKHKKR

SEQ ID NO: 654 - protein, 35 aa, Artificial Sequence
  Chemically synthesized
KKRREERRKILEEEEQKKKQEEAERKIREEEEKKR

SEQ ID NO: 655 - protein, 35 aa, Artificial Sequence; identical to SEQ ID NO: 654
  Chemically synthesized

SEQ ID NO: 656 - protein, 26 aa, Artificial Sequence
  Chemically synthesized
KKRRREHGQLWFPDGFIPKEPSKKKR

SEQ ID NO: 657 - protein, 27 aa, Artificial Sequence
  Chemically synthesized
KKRRRRDEDSDTEGEQQTQPDGEAKKR

SEQ ID NO: 658 - protein, 31 aa, Artificial Sequence
  Chemically synthesized
KKRRRRDEDSDTEGEQQTQPDGEAKKRRKKR

SEQ ID NO: 659 - protein, 34 aa, Artificial Sequence
  Chemically synthesized
KKRECAANGVDYERAKLLEISAEDAERWERKKKR

SEQ ID NO: 660 - protein, 39 aa, Artificial Sequence
  Chemically synthesized
KKRDEERKRELEERRKKEQEEQLRRLREEEREEDEKKKR

SEQ ID NO: 661 - protein, 41 aa, Artificial Sequence
  Chemically synthesized
KKRSSSRCRSGSDSPARKHSTLAKYRAEVPDRRKKERRKKR

SEQ ID NO: 662 - protein, 26 aa, Artificial Sequence
  Chemically synthesized
KKRRKRPQKAAGSDDDEEQTPQSKKR

SEQ ID NO: 663 - protein, 30 aa, Artificial Sequence
  Chemically synthesized
KKRKKGGSSSGEQGEGGDEGEGGEKKKKKR

SEQ ID NO: 664 - protein, 26 aa, Artificial Sequence
  Chemically synthesized
KKRSYKDLLREEEEIAEQVRKSSKKR

SEQ ID NO: 665 - protein, 45 aa, Artificial Sequence
  Chemically synthesized
KKRKVEKQIPDATKKKKATVKKECFITQERSEEKPDNESNKNKKR

SEQ ID NO: 666 - protein, 27 aa, Artificial Sequence
  Chemically synthesized
KKRHDSPDLSPQEQQTTPDLSLQRKKR

SEQ ID NO: 667 - protein, 30 aa, Artificial Sequence
  Chemically synthesized
KKRKFEKPPDPSVRKRLKLVKEEKLLRKKR

SEQ ID NO: 668 - protein, 27 aa, Artificial Sequence
  Chemically synthesized
KKRRKRPQKGGDGSDDDEDQAPQPKKR

SEQ ID NO: 669 - protein, 32 aa, Artificial Sequence
  Chemically synthesized
KKRRKRPQKGGDGSDDDEDQAPQPKKRQPKKR

SEQ ID NO: 670 - protein, 33 aa, Artificial Sequence
  Chemically synthesized
KKRKKGGGSSGSGGEQGEGGEEGEGGEKKKKKR

SEQ ID NO: 671 - protein, 34 aa, Artificial Sequence
  Chemically synthesized
KKRPEVLTIHENSRQENYETETVQVKQAKPNKKR

SEQ ID NO: 672 - protein, 39 aa, Artificial Sequence
  Chemically synthesized
KKRKHKLQETKGKIKKSESVQNTDPTEEADSSVKKKKKR

SEQ ID NO: 673 - protein, 44 aa, Artificial Sequence
  Chemically synthesized
KKRKNRKKPTILEGKETETPVEKTPEGASGEGKKNKNKKKNKKR

SEQ ID NO: 674 - protein, 39 aa, Artificial Sequence
  Chemically synthesized
KKRKKNFMMMRHSQNVRTKGKRSFREKQIALRDSLLKKR

SEQ ID NO: 675 - protein, 31 aa, Artificial Sequence
  Chemically synthesized
KKRRARSRSNSRSKHRHRSRSRSKSREKKKR

SEQ ID NO: 676 - protein, 42 aa, Artificial Sequence
  Chemically synthesized
KKRRKTCKTSTTDSRSSRLEEDPVGQDIPDESNAQSSPKKKR

SEQ ID NO: 677 - protein, 39 aa, Artificial Sequence
  Chemically synthesized
KKRDEERRRELEERRKKEQEEQLRRLREEEREEEERKKR

SEQ ID NO: 678 - protein, 26 aa, Artificial Sequence
  Chemically synthesized
KKRSYKDLLREEEEIAEQVRKSSKKR

SEQ ID NO: 679 - protein, 34 aa, Artificial Sequence
  Chemically synthesized
KKREREQSETASTAPVEPFTLPKPVEVVVEEKKR

SEQ ID NO: 680 - protein, 31 aa, Artificial Sequence
  Chemically synthesized
KKRAALSILQELKKLPVLPVVEKPKVHYKKR

SEQ ID NO: 681 - protein, 26 aa, Artificial Sequence
  Chemically synthesized
KKRRRREGESDTEEEQTQPDGEGKKR

SEQ ID NO: 682 - protein, 30 aa, Artificial Sequence
  Chemically synthesized
KKRRRREGESDTEEEQTQPDGEGKKRRKKR

SEQ ID NO: 683 - protein, 31 aa, Artificial Sequence
  Chemically synthesized
KKRRPRSRSRSRSKHRHRSKSRSKSREKKKR

SEQ ID NO: 684 - protein, 34 aa, Artificial Sequence
  Chemically synthesized
KKRECAANGVDFERAKLLEISAEDAERWERKKKR

SEQ ID NO: 685 - protein, 46 aa, Artificial Sequence
  Chemically synthesized
KKRKELDDVSEDVETLEMVFESRDLDWEEQTANGDQEAQSNKRKKR

SEQ ID NO: 686 - protein, 30 aa, Artificial Sequence
  Chemically synthesized
KKRAQRILIFLLEFLLDFCTGEDSVDGKKR

SEQ ID NO: 687 - protein, 41 aa, Artificial Sequence
  Chemically synthesized
KKRAPKLRATCSSSGLDNLYNAVANIAKASSLRVEVIHKKR

SEQ ID NO: 688 - protein, 41 aa, Artificial Sequence; identical to SEQ ID NO: 687
  Chemically synthesized

SEQ ID NO: 689 - protein, 45 aa, Artificial Sequence
  Chemically synthesized
KKRRYFMDIWMKDSSGQEFFIEIKPKKETQPPVKPAHLTTAAKKR

SEQ ID NO: 690 - protein, 35 aa, Artificial Sequence
  Chemically synthesized
KKREILIRSLQMIKRQAVKSAANQRNPMGGSWKKR

SEQ ID NO: 691 - protein, 37 aa, Artificial Sequence
  Chemically synthesized
KKRPCKVKRKLFGSENIRPNKKIPLASDVDNELEKKR

SEQ ID NO: 692 - protein, 26 aa, Artificial Sequence
  Chemically synthesized
KKRMDDTEKRKLQEDRRNEKQDLKKR

SEQ ID NO: 693 - protein, 28 aa, Artificial Sequence
  Chemically synthesized
KKRYRSPSSDRSLSRDRSSSRDRSYKKR

SEQ ID NO: 694 - protein, 41 aa, Artificial Sequence
  Chemically synthesized
KKRRPGRGDTSATSDGGTSPKRPLRDSWNLLPQRRAAHKKR

SEQ ID NO: 695 - protein, 26 aa, Artificial Sequence
  Chemically synthesized
KKRVVGLESCSNVLKTRLMRFALKKR

SEQ ID NO: 696 - protein, 1412 aa, Artificial Sequence
  Chemically synthesized
MDYKDHDGDYKDHDIDYKDDDDKGGNSKKRSLEDNETEIKVSRDTWNTKNMRSLEPPRSKKRIHGGNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDANNYPDKGVVEIKALPEIAMSIKKAFGEYAIMKSRGGGGSGGGGSTRQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQRTPQVIGVMQSQNSSAGNRGPRPLEQVTCYKCGEKGHYANRCTKGHLAFLSGQ

SEQ ID NO: 697 - protein, 1736 aa, Artificial Sequence
  Chemically synthesized
MDYKDHDGDYKDHDIDYKDDDDKGGNSKKRSLEDNETEIKVSRDTWNTKNMRSLEPPRSKKRIHGGNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDANNYPDKGVVEIKALPEIAMSIKKAFGEYAIMKSRGGGGSGGGGSTRGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRGHGADVKCVDWHPTKGLVVSGSKDSQQPIKFWDPKTGQSLATLHAHKNTVMEVKLNLNGNWLLTASRDHLCKLFDIRNLKEELQVFRGHKKEATAVAWHPVHEGLFASGGSDGSLLFWHVGVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQI

SEQ ID NO: 698 - protein, 1395 aa, Artificial Sequence
  Chemically synthesized
MDYKDHDGDYKDHDIDYKDDDDKGGNSKKRSLEDNETEIKVSRDTWNTKNMRSLEPPRSKKRIHGGNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDANNYPDKGVVEIKALPEIAMSIKKAFGEYAIMKSRGGGGSGGGGSTRSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 699 - protein, 1407 aa, Artificial Sequence
  Chemically synthesized
MDYKDHDGDYKDHDIDYKDDDDKGGNSKKRSLEDNETEIKVSRDTWNTKNMRSLEPPRSKKRIHGGNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDANNYPDKGVVEIKALPEIAMSIKKAFGEYAIMKSRGGGGSGGGGSTRVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 700 - protein, 1404 aa, Artificial Sequence
  Chemically synthesized
MDYKDHDGDYKDHDIDYKDDDDKGGNSKKRSLEDNETEIKVSRDTWNTKNMRSLEPPRSKKRIHGGNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDANNYPDKGVVEIKALPEIAMSIKKAFGEYAIMKSRGGGGSGGGGSTRVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 701 - protein, 1313 aa, Artificial Sequence
  Chemically synthesized
MDYKDHDGDYKDHDIDYKDDDDKGGNSKKRSLEDNETEIKVSRDTWNTKNMRSLEPPRSKKRIHGGNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDANNYPDKGVVEIKALPEIAMSIKKAFGEYAIMKSRGGGGSGGGGSTRGGRDHMVLHEYVNAAGITGGSGGRDHMVLHEYVNAAGITGGSGGRDHMVLHEYVNAAGITGGSGGRDHMVLHEYVNAAGITGGSGGRDHMVLHEYVNAAGITGGSGGRDHMVLHEYVNAAGITGGSGGRDHMVLHEYVNAAGIT

SEQ ID NO: 702 - protein, 1155 aa, Artificial Sequence
  Chemically synthesized
MDYKDHDGDYKDHDIDYKDDDDKGGNSKKRSLEDNETEIKVSRDTWNTKNMRSLEPPRSKKRIHGGNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 703 - protein, 381 aa, Artificial Sequence
  Chemically synthesized
AVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 704 - protein, 624 aa, Artificial Sequence
  Chemically synthesized
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKGNSRPLEAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 705 - DNA, 3267 bp, Artificial Sequence
  Chemically synthesized
aacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaag

SEQ ID NO: 706 - DNA, 2946 bp, Artificial Sequence
  Chemically synthesized
aacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggat

SEQ ID NO: 707 - DNA, 3267 bp, Artificial Sequence
  Chemically synthesized
aacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatgcaaacaattaccccgacaaaggcgtggtggaaatcaaggccctgcctgagatcgccatgagcatcaagaaggcctttggggagtacgccatcatgaag

SEQ ID NO: 708 - DNA, 3867 bp, Artificial Sequence
  Chemically synthesized
atggactacaaagaccatgacggtgattataaagatcatgacatcgattacaaggatgacgatgacaagggcggaaactcaaagaaaaggtcactggaggacaacgaaacggaaatcaaagtctccagagacacctggaacactaagaacatgcggtccctggaaccgccacgaagcaagaaacggatacatggaggcaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatcgaggcggtggaggtagtggagggggaggatcaacgcgttctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactagtaa

SEQ ID NO: 709 - DNA, 729 bp, Artificial Sequence
  Chemically synthesized
caggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaaaacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacag

SEQ ID NO: 710 - DNA, 1701 bp, Artificial Sequence
  Chemically synthesized
ggctcaccccctcgattcttccacatgccgcgctttcaacaccaagcccccaggcaactcttttacaaacgcccagactttgcgcagcagcaggcgatgcagcagcttactttcgacggaaagcgcatgcgaaaagcggtcaaccgcaagacaatagattacaatcccagtgtcattaaatacctcgagaatcgcatatggcaaagagatcaacgagacatgagagccattcaaccggatgcaggttattacaatgatctggtccctccgatcggcatgttgaataatccaatgaacgctgtcacgaccaaatttgtccgcacaagtactaataaggttaaatgcccagtatttgtagtgcggtggacacccgaaggaaggaggctcgtcacaggagcatcttccggtgaatttactctgtggaatggattgacatttaattttgaaacaatacttcaggcccatgactctccggtgagggccatgacctggtcccacaacgacatgtggatgctgaccgcagaccatggtgggtatgtaaaatactggcagtcaaacatgaataatgtgaagatgtttcaggcccataaagaagctatacgggaggcttctttttcaccaactgataataagttcgccacctgttcagacgatggtacggtccgcatttgggattttctccgatgtcatgaggagagaatactgaggggtcacggagccgatgtcaaatgtgtggactggcatccaaccaagggtcttgtcgtttcaggctccaaagattcccaacagccgattaagttttgggaccctaaaaccggacaatccctggcgacactgcatgcccataagaacacggtcatggaagtcaagctcaatcttaatgggaattggctgctcacggcttctcgggaccacctttgcaagctgttcgatattagaaatttgaaagaagaactgcaggtatttcgagggcataagaaggaagccactgcggtagcctggcacccagtccatgaaggtctgttcgcgagtggggggtctgatggttccctgctcttttggcacgtcggggtagagaaggaagttggtgggatggagatggcgcatgagggcatgatatggagcttggcctggcaccctctcggacatatactctgtagtggcagcaatgatcacacatctaagttttggacacggaacagaccaggcgataaaatgcgggatcgatacaaccttaatctgcttcccgggatgagcgaggacggagtagagtacgatgatctcgagccaaacagtctcgcagtgatacccggcatgggcatccctgagcaactcaaattggccatggagcaagagcagatgggcaaagatgagtctaacgaaatagaaatgaccattcctggccttgattgggggatggaggaagtaatgcagaaagaccagaagaaagtgccacagaaaaaggtcccatacgcgaaaccgattcccgcgcaattccagcaggcatggatgcaaaacaaggtgcctattcccgctccaaatgaagtcctgaacgatcgaaaagaggatattaaactggaggagaaaaaaaagacgcaagcagaaattgagcaggagatggccacgttgcagtacacgaacccacaactgctggagcaattgaaaatcgagcgacttgcgcagaaacaggttgagcagatc

SEQ ID NO: 711 - DNA, 678 bp, Artificial Sequence
  Chemically synthesized
tctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaac

SEQ ID NO: 712 - DNA, 684 bp, Artificial Sequence
  Chemically synthesized
gaagacatctggccgacaatcgagaggacgaccatcagtgcgtccgtaccggaggccccagccaatttcgacgaaaagccgccttttaatagaacgataaacgtctaccctctcacaaactacactttcggcacgaaagatgcccaagcagagaaagacaaatcagtcccggaaaggtttaagcgcatgaaagatgagtacgaagtcatgggaatgcgaagaagcgttgaagccgtccttatcgtacatgagcattccttgccgcatatcctgttgctgcagattgggactacattctataaactcccagggggagaattggagttgggcgaagatgagattagtggggtgacccgattgttgaacgaaaccctgggtaggacagatggagaaaccaatgaatggacgatcgaggatgaaattgggaactggtggcggcccaattttgacccacctcggtatccgtacattcctgcacacgtcacaaaacccaaggagcatacaaagctgctgctggtccagcttccctccaagtcaactttttgtgtaccaaaaaattttaagctggtggctgcgccactcttcgagctgtacgacaacgcggcggcttacggtcctctgatttcatcacttcctacgacgttgagtcggttcaactttatatttaacgacagtaactagtaa

SEQ ID NO: 713 - DNA, 714 bp, Artificial Sequence
  Chemically synthesized
gcaagctcacaagttagtaacaaatctggcagtgggtggcctagacgagggtctcaaggccaggctgacgcagcatctagcaataataacgggacccaaaagtacacaaaccaggctctgaccattaaccgcacgatcaatttgtatccattgaccaattataccttcgggacgaaggagccgctttttgagaaagatccgagtgtgccatcaaggttccaaagaatgcgcgaagaatttgatcggataggcatgcggcggtcagtggagggtgtgctcctggtccacgaacacggcctgccccatgtcctgctgctccagcttgggactactttcttcaagttgcctggtggagaactgaacgccggtgaagatgaggtggaaggacttaaacgcctcttgtctgaaacccttggccgacaggatggcgttaaacaagagtggatagtagaggacaccatcggcaattggtggaggccaaacttcgaaccgccgcaatatccttatatacctccgcacatcacgaagcccaaggagcacaagagactgttcttggtccaactccatgaaaaggcattgttcgcggtcccaaagaactataagctcgttgcagcgcctctgttcgagttgtatgataactcccaggggtacggccccatcattagctccctgccgcaggcgctctgtcgctttaattttatttacatgtagtaa

SEQ ID NO: 714 - DNA, 597 bp, Artificial Sequence
  Chemically synthesized
ctgaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactagtaa

SEQ ID NO: 715 - DNA, 684 bp, Artificial Sequence
  Chemically synthesized
tctgtggtaccgcccaatcgctcgcagaccggctggcctagaggcgtcactcagttcggcaacaagtacatccagcagacgaagcccctcaccctggagcgcaccatcaacctgtaccctcttaccaattatacttttggtacaaaagagcccctctacgagaaggacagctctgttgcagccagctttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactagtaa

SEQ ID NO: 716 - DNA, 684 bp, Artificial Sequence
  Chemically synthesized
tctgtggtaccgcccaatcgctcgcagaccggctggcctagaggcgtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactgccttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactagtaa

SEQ ID NO: 717 - DNA, 1392 bp, Artificial Sequence
  Chemically synthesized
tctgtagttcccccaaataggtcccaaacggggtggcctagaggcgtcacgcaattcgggaacaaatatatacaacagacaaaacctcttactctggagcggacgataaatttgtaccccctgacaaactacacgtttggtacgaaggaaccattgtacgagaaagattcttcagtcgctgctcggtttcaaaggatgcgagaagagttcgataagataggtatgcgacggaccgtagaaggggtcctcattgtgcacgaacatcgcctgcctcatgtgttgcttctccaactcggcacaacgttctttaaactgcctgggggcgaacttaaccctggggaagatgaggtggaggggctcaaaagattgatgaccgaaatcctgggcagacaggacggcgttctgcaggattgggttatagacgattgtataggtaactggtggcgaccgaacttcgaaccgccgcaatacccatatatccccgctcacataacaaagcccaaggagcacaagaaattgtttcttgtacagcttcaggaaaaagcactcttcgcagtgcccaagaactacaaacttgtagctgcgcccttgttcgagttgtatgataacgctcccggttatggcccgatcatatcatcccttccacaattgctcagtcgctttaatttcatttataatggaggtggaggctctggtggaggcggcagttcagtcgttccgcccaataggtcacagacgggttggccccgaggggtcacacaattcggcaacaaatacattcagcagaccaagccccttactttggaacggaccatcaatctgtatccgctcacgaattacacgttcggaaccaaagagccattgtacgagaaggattccagcgttgccgcgagattccagaggatgagagaagagttcgataagataggaatgcgcaggactgttgaaggggtactcatagtccatgaacacagactcccgcacgtccttctgctgcagttgggcacgacctttttcaagttgccaggtggggaattgaatccaggagaagacgaagtagaaggtctcaagcgcctcatgacagagattcttggacggcaggatggcgtacttcaagactgggtcatagacgactgtattggtaactggtggcggcccaactttgaaccgccgcagtacccctacatcccggcccacatcacaaaacctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactagtaa

SEQ ID NO: 718 - DNA, 714 bp, Artificial Sequence
  Chemically synthesized
gtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 719 - DNA, 710 bp, Artificial Sequence
  Chemically synthesized
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaaggg

SEQ ID NO: 720 - DNA, 432 bp, Artificial Sequence
  Chemically synthesized
ggaggtagagatcacatggtactgcacgaatatgtaaatgctgcaggcatcactggtggctcaggagggcgcgaccacatggttttgcacgagtatgtgaacgccgccggaataacggggggttcaggaggccgggatcatatggttctccatgaatatgtcaacgcggctggtattacgggcggatcaggcgggcgggatcacatggttcttcacgaatacgtcaacgcggctggaattacaggtggttccggaggaagagatcacatggtactccacgaatatgttaatgctgcaggtataactggcggctctgggggtcgggatcatatggtgttgcatgaatacgtcaacgcagccgggataaccggaggttctggtggtcgagatcacatggtactccatgaatatgtaaatgcggctggaataaca

SEQ ID NO: 721 - DNA, 648 bp, Artificial Sequence
  Chemically synthesized
atgagcaagggcgaagaactcttcacgggggtggtgccaatcctggtagaattggatggggatgtaaatggccataagttttctgtaaggggagaaggtgaaggggatgctacaattgggaaactgaccttgaagtttatctgtacaaccggcaagctgcctgtgccatggcccacattggttacgactctcacatacggcgtacagtgtttctccaggtatccggaccatatgaaacgacacgacttctttaagagcgcaatgccggagggttacgtacaagaacgaactatttccttcaaagacgacggtaaatataagaccagggcagtagttaagtttgaaggggatacgctcgtcaatcgcatagagttgaagggaacagactttaaagaggatggtaacatacttgggcataagctcgaatacaacttcaacagccacaacgtctacataaccgccgacaagcagaaaaacgggattaaagccaactttactgtgcggcacaatgttgaggatggctctgtgcagcttgctgaccactaccagcaaaatacccccattggagatgggcccgtcctgttgccggacaatcattatctgtctacgcaaactgtccttagcaaagacccaaacgagaaataataa

SEQ ID NO: 722 - DNA, 42 bp, Artificial Sequence
  Chemically synthesized
tcgcgaggcggtggaggtagtggagggggaggatcaacgcgt

SEQ ID NO: 723 - DNA, 66 bp, Artificial Sequence
  Chemically synthesized
gactacaaagaccatgacggtgattataaagatcatgacatcgattacaaggatgacgatgacaag

SEQ ID NO: 724 - DNA, 117 bp, Artificial Sequence
  Chemically synthesized
aactcaaagaaaaggtcactggaggacaacgaaacggaaatcaaagtctccagagacacctggaacactaagaacatgcggtccctggaaccgccacgaagcaagaaacggatacat

SEQ ID NO: 725 - DNA, 4242 bp, Artificial Sequence
  Chemically synthesized
atggactacaaagaccatgacggtgattataaagatcatgacatcgattacaaggatgacgatgacaagggcggaaactcaaagaaaaggtcactggaggacaacgaaacggaaatcaaagtctccagagacacctggaacactaagaacatgcggtccctggaaccgccacgaagcaagaaacggatacatggaggcaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatgcaaacaattaccccgacaaaggcgtggtggaaatcaaggccctgcctgagatcgccatgagcatcaagaaggcctttggggagtacgccatcatgaagtcgcgaggcggtggaggtagtggagggggaggatcaacgcgtcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaaaacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtagtaa

SEQ ID NO: 726 - DNA, 5214 bp, Artificial Sequence
  Chemically synthesized
atggactacaaagaccatgacggtgattataaagatcatgacatcgattacaaggatgacgatgacaagggcggaaactcaaagaaaaggtcactggaggacaacgaaacggaaatcaaagtctccagagacacctggaacactaagaacatgcggtccctggaaccgccacgaagcaagaaacggatacatggaggcaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatgcaaacaattaccccgacaaaggcgtggtggaaatcaaggccctgcctgagatcgccatgagcatcaagaaggcctttggggagtacgccatcatgaagtcgcgaggcggtggaggtagtggagggggaggatcaacgcgtggctcaccccctcgattcttccacatgccgcgctttcaacaccaagcccccaggcaactcttttacaaacgcccagactttgcgcagcagcaggcgatgcagcagcttactttcgacggaaagcgcatgcgaaaagcggtcaaccgcaagacaatagattacaatcccagtgtcattaaatacctcgagaatcgcatatggcaaagagatcaacgagacatgagagccattcaaccggatgcaggttattacaatgatctggtccctccgatcggcatgttgaataatccaatgaacgctgtcacgaccaaatttgtccgcacaagtactaataaggttaaatgcccagtatttgtagtgcggtggacacccgaaggaaggaggctcgtcacaggagcatcttccggtgaatttactctgtggaatggattgacatttaattttgaaacaatacttcaggcccatgactctccggtgagggccatgacctggtcccacaacgacatgtggatgctgaccgcagaccatggtgggtatgtaaaatactggcagtcaaacatgaataatgtgaagatgtttcaggcccataaagaagctatacgggaggcttctttttcaccaactgataataagttcgccacctgttcagacgatggtacggtccgcatttgggattttctccgatgtcatgaggagagaatactgaggggtcacggagccgatgtcaaatgtgtggactggcatccaaccaagggtcttgtcgtttcaggctccaaagattcccaacagccgattaagttttgggaccctaaaaccggacaatccctggcgacactgcatgcccataagaacacggtcatggaagtcaagctcaatcttaatgggaattggctgctcacggcttctcgggaccacctttgcaagctgttcgatattagaaatttgaaagaagaactgcaggtatttcgagggcataagaaggaagccactgcggtagcctggcacccagtccatgaaggtctgttcgcgagtggggggtctgatggttccctgctcttttggcacgtcggggtagagaaggaagttggtgggatggagatggcgcatgagggcatgatatggagcttggcctggcaccctctcggacatatactctgtagtggcagcaatgatcacacatctaagttttggacacggaacagaccaggcgataaaatgcgggatcgatacaaccttaatctgcttcccgggatgagcgaggacggagtagagtacgatgatctcgagccaaacagtctcgcagtgatacccggcatgggcatccctgagcaactcaaattggccatggagcaagagcagatgggcaaagatgagtctaacgaaatagaaatgaccattcctggccttgattgggggatggaggaagtaatgcagaaagaccagaagaaagtgccacagaaaaaggtcccatacgcgaaaccgattcccgcgcaattccagcaggcatggatgcaaaacaaggtgcctattcccgctccaaatgaagtcctgaacgatcgaaaagaggatattaaactggaggagaaaaaaaagacgcaagcagaaattgagcaggagatggccacgttgcagtacacgaacccacaactgctggagcaattgaaaatcgagcgacttgcgcagaaacaggttgagcagatctagtaa

SEQ ID NO: 727 - DNA, 4191 bp, Artificial Sequence
  Chemically synthesized
atggactacaaagaccatgacggtgattataaagatcatgacatcgattacaaggatgacgatgacaagggcggaaactcaaagaaaaggtcactggaggacaacgaaacggaaatcaaagtctccagagacacctggaacactaagaacatgcggtccctggaaccgccacgaagcaagaaacggatacatggaggcaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatgcaaacaattaccccgacaaaggcgtggtggaaatcaaggccctgcctgagatcgccatgagcatcaagaaggcctttggggagtacgccatcatgaagtcgcgaggcggtggaggtagtggagggggaggatcaacgcgttctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactagtaa

SEQ ID NO: 728 - DNA, 4227 bp, Artificial Sequence
  Chemically synthesized
atggactacaaagaccatgacggtgattataaagatcatgacatcgattacaaggatgacgatgacaagggcggaaactcaaagaaaaggtcactggaggacaacgaaacggaaatcaaagtctccagagacacctggaacactaagaacatgcggtccctggaaccgccacgaagcaagaaacggatacatggaggcaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatgcaaacaattaccccgacaaaggcgtggtggaaatcaaggccctgcctgagatcgccatgagcatcaagaaggcctttggggagtacgccatcatgaagtcgcgaggcggtggaggtagtggagggggaggatcaacgcgtgtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtagtaa

SEQ ID NO: 729 - DNA, 4218 bp, Artificial Sequence
  Chemically synthesized
atggactacaaagaccatgacggtgattataaagatcatgacatcgattacaaggatgacgatgacaagggcggaaactcaaagaaaaggtcactggaggacaacgaaacggaaatcaaagtctccagagacacctggaacactaagaacatgcggtccctggaaccgccacgaagcaagaaacggatacatggaggcaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatgcaaacaattaccccgacaaaggcgtggtggaaatcaaggccctgcctgagatcgccatgagcatcaagaaggcctttggggagtacgccatcatgaagtcgcgaggcggtggaggtagtggagggggaggatcaacgcgtgtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtagtaa

SEQ ID NO: 730 - DNA, 3945 bp, Artificial Sequence
  Chemically synthesized
atggactacaaagaccatgacggtgattataaagatcatgacatcgattacaaggatgacgatgacaagggcggaaactcaaagaaaaggtcactggaggacaacgaaacggaaatcaaagtctccagagacacctggaacactaagaacatgcggtccctggaaccgccacgaagcaagaaacggatacatggaggcaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatgcaaacaattaccccgacaaaggcgtggtggaaatcaaggccctgcctgagatcgccatgagcatcaagaaggcctttggggagtacgccatcatgaagtcgcgaggcggtggaggtagtggagggggaggatcaacgcgtggaggtagagatcacatggtactgcacgaatatgtaaatgctgcaggcatcactggtggctcaggagggcgcgaccacatggttttgcacgagtatgtgaacgccgccggaataacggggggttcaggaggccgggatcatatggttctccatgaatatgtcaacgcggctggtattacgggcggatcaggcgggcgggatcacatggttcttcacgaatacgtcaacgcggctggaattacaggtggttccggaggaagagatcacatggtactccacgaatatgttaatgctgcaggtataactggcggctctgggggtcgggatcatatggtgttgcatgaatacgtcaacgcagccgggataaccggaggttctggtggtcgagatcacatggtactccatgaatatgtaaatgcggctggaataacatagtaa

SEQ ID NO: 731 - DNA, 3471 bp, Artificial Sequence
  Chemically synthesized
atggactacaaagaccatgacggtgattataaagatcatgacatcgattacaaggatgacgatgacaagggcggaaactcaaagaaaaggtcactggaggacaacgaaacggaaatcaaagtctccagagacacctggaacactaagaacatgcggtccctggaaccgccacgaagcaagaaacggatacatggaggcaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagtagtaa

SEQ ID NO: 732 - DNA, 155 bp, Artificial Sequence
  Chemically synthesized
  misc_feature (62)..(102): n is a, c, g, t or u
ctttctactctgttgacaaccattgtctcctcttattttcttttcattttctgtaacttttnnnnnnnnnnnnnnnnnnnnnnnnnnnnnnnnnnnnnnnnncacttttgtttatttgtcagattgtaagtactttctctaatcacttttttttc

SEQ ID NO: 733 - DNA, 38 bp, Artificial Sequence
  Chemically synthesized
ctttctactctgttgacaaccataaaaaaaaaaaaaaa

SEQ ID NO: 734 - DNA, 41 bp, Artificial Sequence
  Chemically synthesized
ctttctactctgttgacaaccattgtaaaaaaaaaaaaaaa

SEQ ID NO: 735 - DNA, 47 bp, Artificial Sequence
  Chemically synthesized
ctttctactctgttgacaaccattgtaataagaaaaaaaaaaaaaaa

SEQ ID NO: 736 - DNA, 54 bp, Artificial Sequence
  Chemically synthesized
ctttctactctgttgacaaccattgtctcctcttattttaaaaaaaaaaaaaaa

SEQ ID NO: 737 - DNA, 61 bp, Artificial Sequence
  Chemically synthesized
ctttctactctgttgacaaccattgtctcctcttattttctttaagaaaaaaaaaaaaaaa

SEQ ID NO: 738 - DNA, 69 bp, Artificial Sequence
  Chemically synthesized
ctttctactctgttgacaaccattgtctcctcttattttcttttcattttctgcaaaaaaaaaaaaaaa

SEQ ID NO: 739 - DNA, 118 bp, Artificial Sequence
  Chemically synthesized
  misc_feature (62)..(102): n is a, c, g, t or u
ctttctactctgttgacaaccattgtctcctcttattttcttctcattttctgtaacttttnnnnnnnnnnnnnnnnnnnnnnnnnnnnnnnnnnnnnnnnncaaaaaaaaaaaaaaa

SEQ ID NO: 740 - DNA, 120 bp, Artificial Sequence
  Chemically synthesized
  misc_feature (62)..(102): n is a, c, g, t or u
ctttctactctgttgacaaccattgtctcctcttattttcttttcattttctgtaacttttnnnnnnnnnnnnnnnnnnnnnnnnnnnnnnnnnnnnnnnnncacaaaaaaaaaaaaaaa

SEQ ID NO: 741 - DNA, 128 bp, Artificial Sequence
  Chemically synthesized
  misc_feature (62)..(102): n is a, c, g, t or u
ctttctactctgttgacaaccattgtctcctcttattttcttttcattttctgtaacttttnnnnnnnnnnnnnnnnnnnnnnnnnnnnnnnnnnnnnnnnncacttttgtctaaaaaaaaaaaaaaa

SEQ ID NO: 742 - DNA, 131 bp, Artificial Sequence
  Chemically synthesized
  misc_feature (62)..(102): n is a, c, g, t or u
ctttctactctgttgacaaccattgtctcctcttattttcttttcattttctgtaacttttnnnnnnnnnnnnnnnnnnnnnnnnnnnnnnnnnnnnnnnnncacttttgtttatcaaaaaaaaaaaaaaa

SEQ ID NO: 743 - DNA, 155 bp, Artificial Sequence
  Chemically synthesized
  misc_feature (62)..(102): n is a, c, g, t or u
ctttctactctgttgacaaccattgtctcctcttattttcttttcattttctgtaacttttnnnnnnnnnnnnnnnnnnnnnnnnnnnnnnnnnnnnnnnnncacttttgtttatttgtcagattgtaagtactttctctaaaaaaaaaaaaaaa

SEQ ID NO: 744 - DNA, 30 bp, Artificial Sequence
  Chemically synthesized
ggagacaatggttgtcaacagagtagaaag

SEQ ID NO: 745 - DNA, 30 bp, Artificial Sequence
  Chemically synthesized
ggcctcagttattctgtctatgaaatggga

SEQ ID NO: 746 - DNA, 68 bp, Artificial Sequence
  Chemically synthesized
  misc_feature (68)..(68): n is a, c, g, t or u
ccatcctaatacgactcactatagggcactcactatagggctcgagcggcttttttttttttttttvn

SEQ ID NO: 747 - DNA, 27 bp, Artificial Sequence
  Chemically synthesized
ccatcctaatacgactcactatagggc

SEQ ID NO: 748 - DNA, 23 bp, Artificial Sequence
  Chemically synthesized
actcactatagggctcgagcggc

SEQ ID NO: 749 - DNA, 20 bp, Artificial Sequence
  Chemically synthesized
ccccttgtcccttggcagca

SEQ ID NO: 750 - DNA, 20 bp, Artificial Sequence
  Chemically synthesized
agcggtggcagtggcagtga

SEQ ID NO: 751 - DNA, 21 bp, Artificial Sequence
  Chemically synthesized
tggggacccttcgtgaccaca

SEQ ID NO: 752 - DNA, 29 bp, Artificial Sequence
  Chemically synthesized
tgctgctgggattacatgattgttctttc

SEQ ID NO: 753 - DNA, 20 bp, Artificial Sequence
  Chemically synthesized
agctcaaggatctggtggtg

SEQ ID NO: 754 - DNA, 20 bp, Artificial Sequence
  Chemically synthesized
gacagcagtgcgcagactta

SEQ ID NO: 755 - DNA, 20 bp, Artificial Sequence
  Chemically synthesized
gacagcccagtctttgagga

SEQ ID NO: 756 - DNA, 20 bp, Artificial Sequence
  Chemically synthesized
caggacaggcagaggaagac

SEQ ID NO: 757 - DNA, 20 bp, Artificial Sequence
  Chemically synthesized
aaggacacagcacacaacca

SEQ ID NO: 758 - DNA, 20 bp, Artificial Sequence
  Chemically synthesized
ctgggcttcttctcatttcc

SEQ ID NO: 759 - DNA, 1367 bp, Artificial Sequence
  Chemically synthesized
atgagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccatggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaaaggtattgattttaaagaagatggaaacattctcggacacaaactggagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagaggcctgatcctgagaacttcagggtgagtttggggacccttcgtgaccacatggtccttcttgagtttgtaactgctgctgggattacatgattgttctttctttttcgctattgtaaaattcatgttatatggagggggcaaagttttcagggtgttgtttagaatggggtcttcctcgaggaagacctggaagatgtcccttgtatcaccatggaccctcatgataattttgtttctttcactttctactctgttgacaaccattgtctcctcttattttcttttcattttctgtaactttttcgttaaactttagcttgcatttgtaacgaatttttaaattcacttttgtttatttgtcagattgtaagtactttctctaatcacttttttttcaaggcaatcagggtatattatattgtacttcagcacagttttagagaacaattgttataattaaatgataaggtagaatatttctgcatataaattctggctggcgtggaaatattcttattggtagaaacaactacatcctggtcatcatcctgcctttctctttatggttacaatgatatacactgtttgagatgaggataaaatactctgagtccaaaccgggcccctctgctaaccatgttcatgccttcttctttttcctacagctcctgggcaacgtgctggttattgtgctgtctcatcattttggcaaagaataataa

SEQ ID NO: 760 - DNA, 1143 bp, Artificial Sequence
  Chemically synthesized
gcagtctctgtaacaccaattagggataccaaatggctgacgctggaggtatgccgagagtttcaacgcggaacctgtagtcgccctgatacggagtgcaagtttgcccacccctctaagtcttgccaagtagagaatgggagagtcatcgcttgcttcgacagtcttaaaggccgatgttcacgggaaaactgcaaatatcttcacccgccgccacatctcaaaactcagcttgagatcaacggtcggaacaaccttatccaacagaaaaatatggctatgttggcgcagcagatgcagcttgcaaatgctatgatgcccggtgcacctttgcaaccggttccaatgttctcagtggctccatccctcgcaacaaatgcctccgcagcggcttttaacccgtacctcggccccgtatccccatcccttgtgcccgcggagatacttccgacggcacccatgttggttacaggcaatccaggggtacccgtacccgcggcagcggccgctgcggcgcaaaaacttatgcggacagatcggctcgaagtctgtagagaatatcaaaggggtaactgtaacaggggggaaaacgactgcagattcgctcacccagcggatagtacaatgatcgacacgaatgacaacaccgttaccgtatgcatggactacattaagggccgctgcagcagagagaagtgcaaatactttcacccacccgcccatctgcaagccaaaatcaaggcggctcaataccaagtcaatcaagcggcggccgctcaagccgcagccactgcggcagcaatgggtatcccgcaagccgttcttccccctctcccaaagcgaccggccctcgaaaaaaccaatggagctaccgccgtcttcaatacgggcatcttccagtaccaacaagccttggctaatatgcaacttcaacaacacacagcgttcttgccaccaggatctatcctttgcatgacgccagccacgagtgtggtgcccatggttcacggtgcgacgccagcgactgtatctgcggctactacgtccgcaacatccgttccgtttgccgcgactgccacggcaaatcaaataccgataattagcgcagaacacttgacgagccacaaatacgtcactcaaatg

SEQ ID NO: 761 - DNA, 1875 bp, Artificial Sequence
  Chemically synthesized
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaaggggaattcaaggcctctcgaggcagtctctgtaacaccaattagggataccaaatggctgacgctggaggtatgccgagagtttcaacgcggaacctgtagtcgccctgatacggagtgcaagtttgcccacccctctaagtcttgccaagtagagaatgggagagtcatcgcttgcttcgacagtcttaaaggccgatgttcacgggaaaactgcaaatatcttcacccgccgccacatctcaaaactcagcttgagatcaacggtcggaacaaccttatccaacagaaaaatatggctatgttggcgcagcagatgcagcttgcaaatgctatgatgcccggtgcacctttgcaaccggttccaatgttctcagtggctccatccctcgcaacaaatgcctccgcagcggcttttaacccgtacctcggccccgtatccccatcccttgtgcccgcggagatacttccgacggcacccatgttggttacaggcaatccaggggtacccgtacccgcggcagcggccgctgcggcgcaaaaacttatgcggacagatcggctcgaagtctgtagagaatatcaaaggggtaactgtaacaggggggaaaacgactgcagattcgctcacccagcggatagtacaatgatcgacacgaatgacaacaccgttaccgtatgcatggactacattaagggccgctgcagcagagagaagtgcaaatactttcacccacccgcccatctgcaagccaaaatcaaggcggctcaataccaagtcaatcaagcggcggccgctcaagccgcagccactgcggcagcaatgggtatcccgcaagccgttcttccccctctcccaaagcgaccggccctcgaaaaaaccaatggagctaccgccgtcttcaatacgggcatcttccagtaccaacaagccttggctaatatgcaacttcaacaacacacagcgttcttgccaccaggatctatcctttgcatgacgccagccacgagtgtggtgcccatggttcacggtgcgacgccagcgactgtatctgcggctactacgtccgcaacatccgttccgtttgccgcgactgccacggcaaatcaaataccgataattagcgcagaacacttgacgagccacaaatacgtcactcaaatgtag

SEQ ID NO: 762 - DNA, 30 bp, Artificial Sequence
  Chemically synthesized
gcagcagcagcagcagcagcagcagcagca

SEQ ID NO: 763 - DNA, 31 bp, Artificial Sequence
  Chemically synthesized
gagcagcagcagcagcagcagcagcagcagc

SEQ ID NO: 764 - DNA, 31 bp, Artificial Sequence
  Chemically synthesized
gcagcagcagcagcagcagcagcagcagcag

SEQ ID NO: 765 - DNA, 45 bp, Artificial Sequence
  Chemically synthesized
atgtacagggacctgaccaaccactacaagacctacgaggaaaag

SEQ ID NO: 766 - DNA, 44 bp, Artificial Sequence
  Chemically synthesized
aagatccggaacgccttcgatcacaacaattaccccgacaaagg

SEQ ID NO: 767 - DNA, 1349 bp, Artificial Sequence
  Chemically synthesized
atggaggaggacaacatggccatcatcaaggagttcatgagattcaaggtgcacatggagggcagcgtgaacggccacgagttcgagatcgagggcgagggcgagggccacccctacgagggcacccagaccgccaagctgaaggtgaccaagggcggccccctgcccttcgcctgggacatcctgagcccccagttcatgtacggcagcaaagcctacgtgaagcaccccgccgacatccccgactacctgaagctgagcttccccgagggcttcacctgggagagagtgatgaacttcgaggacggcggcgtggtgaccgtgacccaggacagcagcctgcaggacggccagttcatctacaaggtgaagctgctgggcatcaacttccccagcgacggccccgtgatgcagaagaaaaccatgggctgggaggccagcaccgagagaatgtaccccgaggacggcgccctgaagggcgagatcaaccagagactgaagctgaaggacggcggccactacgacgccgaggtgaaaaccacctacaaggccaagaagcccgtgcagctgcccggcgcctacaacgtggacatcaagctggacatcaccagccacaacgaggacaggcctgatcctgagaacttcagggtgagtttggggaccctttacaccatcgtggagcagtacgagagagccgaggccagacacagcacctgattgttctttctttttcgctattgtaaaattcatgttatatggagggggcaaagttttcagggtgttgtttagaatggggtcttcctcgaggaagacctggaagatgtcccttgtatcaccatggaccctcatgataattttgtttctttcactttctactctgttgacaaccattgtctcctcttattttcttttcattttctgtaactttttcgttaaactttagcttgcatttgtaacgaatttttaaattcacttttgtttatttgtcagattgtaagtactttctctaatcacttttttttcaaggcaatcagggtatattatattgtacttcagcacagttttagagaacaattgttataattaaatgataaggtagaatatttctgcatataaattctggctggcgtggaaatattcttattggtagaaacaactacatcctggtcatcatcctgcctttctctttatggttacaatgatatacactgtttgagatgaggataaaatactctgagtccaaaccgggcccctctgctaaccatgttcatgccttcttctttttcctacagctcctgggcaacgtgctggttattgtgctgtctcatcattttggcaaagaataataa

SEQ ID NO: 768 - DNA, 61 bp, Artificial Sequence
  Chemically synthesized
ctttctactctgttgacaaccattgtctcctcttattttcttttcattttctgtaactttt

SEQ ID NO: 769 - DNA, 38 bp, Artificial Sequence; identical to SEQ ID NO: 733
  Chemically synthesized

SEQ ID NO: 770 - DNA, 41 bp, Artificial Sequence; identical to SEQ ID NO: 734
  Chemically synthesized

SEQ ID NO: 771 - DNA, 44 bp, Artificial Sequence
  Chemically synthesized
ctttctactctgttgacaaccataataagaaaaaaaaaaaaaaa

SEQ ID NO: 772 - DNA, 54 bp, Artificial Sequence; identical to SEQ ID NO: 736
  Chemically synthesized

SEQ ID NO: 773 - DNA, 58 bp, Artificial Sequence
  Chemically synthesized
ctttctactctgttgacaaccattgtctcctcttattttaaagaaaaaaaaaaaaaaa

SEQ ID NO: 774 - protein, 33 aa, Artificial Sequence
  Chemically synthesized
FEDSKAKPEQRPSLHSRGMLDRSRLALCTLVFL

SEQ ID NO: 775 - protein, 7 aa, Artificial Sequence
  Chemically synthesized
FEDSKTE

SEQ ID NO: 776 - DNA, 32 bp, Artificial Sequence
  Chemically synthesized
ccccccccttcccagccccaaaaaaaaaaaaa

SEQ ID NO: 777 - protein, 21 aa, Artificial Sequence
  Chemically synthesized
FEDSKVGPCHGAPFPTPSHIL

SEQ ID NO: 778 - DNA, 36 bp, Artificial Sequence
  Chemically synthesized
gttgtggaaggtccagttttgaggggctattacaac

SEQ ID NO: 779 - DNA, 34 bp, Artificial Sequence
  Chemically synthesized
gttggaactgctcattttggagggtaatcacaac

SEQ ID NO: 780 - DNA, 36 bp, Artificial Sequence
  Chemically synthesized
gttgcatctgccttctttttgaaaggtaaaaacaac

SEQ ID NO: 781 - DNA, 66 bp, Artificial Sequence
  Chemically synthesized
  misc_feature (1)..(30): n is a, c, g, t or u
nnnnnnnnnnnnnnnnnnnnnnnnnnnnnnguuguggaagguccaguuuugaggggcuauuacaac

SEQ ID NO: 782 - DNA, 36 bp, Artificial Sequence
  Chemically synthesized
gttgtggaaggtccagctttgaggggctattacaac

SEQ ID NO: 783 - DNA, 36 bp, Artificial Sequence
  Chemically synthesized
gttgtggaaggtccagtcttgaggggctattacaac

SEQ ID NO: 784 - DNA, 36 bp, Artificial Sequence
  Chemically synthesized
gttgtggaaggtccagttctgaggggctattacaac

SEQ ID NO: 785 - DNA, 59 bp, Artificial Sequence
  Chemically synthesized
cugcugcugcugcugcugcugcugcugcugcugcugcugcugcugcugcugcugaaaaa

SEQ ID NO: 786 - DNA, 38 bp, Artificial Sequence
  Chemically synthesized
cugcugcugcugcugcugcugcugcugcugcugcugcu

SEQ ID NO: 787 - DNA, 65 bp, Artificial Sequence
  Chemically synthesized
gcagcagcagcagcagcagcagcagcagcauuguggaagguccaguuuugaggggcuauuacaac

SEQ ID NO: 788 - DNA, 51 bp, Artificial Sequence
  Chemically synthesized
cugcugcugcugcugcugcugcugcugcugcugcugcugcugcugcugcug

SEQ ID NO: 789 - DNA, 6 bp, Artificial Sequence
  Chemically synthesized
aauaaa

What is claimed is:

1. A fusion protein comprising:
   a) a CRISPR-associated (Cas) protein; and
   b) a cleavage or polyadenylation protein,
   wherein the cleavage or polyadenylation protein is NUDT21.

2. The fusion protein of claim 1, wherein the Cas protein is catalytically dead Cas13 (dCas13).

3. The fusion protein of claim 2, wherein dCas13 comprises a sequence selected from SEQ ID NOs: 47-48, or a variant thereof.

4. The fusion protein of claim 1, wherein NUDT21 comprises a sequence selected from SEQ ID NOs: 51-58, or a variant thereof.

5. The fusion protein of claim 1, wherein the fusion protein further comprises a nuclear localization signal (NLS).

6. The fusion protein of claim 5, wherein NLS comprises a sequence selected from SEQ ID NOs: 75-695, or a variant thereof.

7. The fusion protein of claim 1, wherein the fusion protein comprises a sequence selected from SEQ ID NOs: 696-698, or a variant thereof.

8. A nucleic acid molecule encoding the fusion protein of claim 1.

9. A method of modulating the cleavage, polyadenylation or both of an RNA transcript in a subject, the method comprising administering to the subject: a fusion protein of claim 1, or a nucleic acid molecule encoding the fusion protein, and a guide nucleic acid comprising a sequence complementary to a target RNA sequence in the RNA transcript.

10. The method of claim 9 being either an in vitro or in vivo method.

* * * * *